US011939397B2

(12) United States Patent
Didonato et al.

(10) Patent No.: US 11,939,397 B2
(45) Date of Patent: Mar. 26, 2024

(54) ENTPD2 ANTIBODIES, COMBINATION THERAPIES, AND METHODS OF USING THE ANTIBODIES AND COMBINATION THERAPIES

(71) Applicant: Novartis AG, Basel (CH)

(72) Inventors: Michael Didonato, San Diego, CA (US); Christoph Erkel, Puchheim (DE); Anna Galkin, Encinitas, CA (US); Scott Glaser, San Diego, CA (US); Klaus Felix Hartlepp, Munich (DE); Yong Jia, San Diego, CA (US); Alexandra Kraus, Munich (DE); Christian Cho-Hua Lee, San Diego, CA (US); Sarah Michelle Rue, San Diego, CA (US); Jian Shi, San Diego, CA (US); Xenia Karola Wezler, Munich (DE)

(73) Assignee: Novartis AG, Basel (CH)

( * ) Notice: Subject to any disclaimer, the term of this patent is extended or adjusted under 35 U.S.C. 154(b) by 552 days.

(21) Appl. No.: 17/058,870

(22) PCT Filed: May 29, 2019

(86) PCT No.: PCT/IB2019/054422
§ 371 (c)(1),
(2) Date: Nov. 25, 2020

(87) PCT Pub. No.: WO2019/229658
PCT Pub. Date: Dec. 5, 2019

(65) Prior Publication Data
US 2021/0155713 A1    May 27, 2021

Related U.S. Application Data

(60) Provisional application No. 62/677,850, filed on May 30, 2018.

(51) Int. Cl.
| | |
|---|---|
| *C07K 16/40* | (2006.01) |
| *A61K 39/00* | (2006.01) |
| *A61K 39/395* | (2006.01) |
| *A61K 45/06* | (2006.01) |
| *A61P 35/00* | (2006.01) |
| *C07K 16/28* | (2006.01) |

(52) U.S. Cl.
CPC ........ *C07K 16/40* (2013.01); *A61K 39/39541* (2013.01); *A61K 39/3955* (2013.01); *A61K 45/06* (2013.01); *A61P 35/00* (2018.01); *C07K 16/2818* (2013.01); *A61K 2039/505* (2013.01); *A61K 2039/507* (2013.01); *C07K 2317/24* (2013.01); *C07K 2317/33* (2013.01); *C07K 2317/55* (2013.01); *C07K 2317/92* (2013.01)

(58) Field of Classification Search
CPC .................................................. C07K 16/40
See application file for complete search history.

(56) References Cited

FOREIGN PATENT DOCUMENTS

WO    2017089334 A1    6/2017

OTHER PUBLICATIONS

U.S. Appl. No. 17/642,763, filed Oct. 2022, Novartis.*
U.S. Appl. No. 17/642,766, filed Sep. 2022, Novartis.*
Allison, KH, et al, Heterogeneity and Cancer, retrieved from: https://www.cancernetwork.com/view/heterogeneity-and-cancer (Year: 2014).*
Chiu, D KC, et al, Hypoxia inducible factor HIF-1 promotes myeloid-derived suppressor cells accumulation through ENTPD2/CD39L1 in hepatocellular carcinoma. Nat Commun 8, 517 (Year: 2017).*
Chui et al., "Hypoxia inducible factor HIF-1 promotes myeloid-derived suppressor cells accumulation through ENTPD2/CD39L1 in hepatocellular carcinoma", Nature Communications, vol. 8, No. 1, Dec. 1, 2017, XP055623761, GB, ISSN: 2041-1723, DOI: 10.1038/41467-017-00530-7.
Hausler et al, "Anti-CD39 and anti-CD73 antibodies A1 and 7G2 improve targeted therapy in ovarian cancer by blocking adenosine-dependent immune evasion", Am J Transl Res, Jan. 1, 2014, vol. 6, Issue 2, pp. 129-139, XP055252605, ISSN: 1943-8141/AJTR1311008.
Robson et al., "The E-NTPDase family of ectonucleotidases: Structure function relationships and pathophysiological significance", Purinergic Signalling, May 30, 2006, vol. 2, Issue 2, pp. 409-430, DOI: 10.1007/s11302-006-9003-5, ISSN: 1573-9546.
Lu et al., "Hydrolysis of Extracellular ATP by Ectonucleoside Triphosphate Diphosphohydrolase (ENTPD) Establishes the Set Point for Fibrotic Activity of Cardiac Fibroblasts", Journal of Biological Chemistry, Jun. 28, 2013, vol. 288, No. 26, pp. 19040-19049.
Bonnefoy et al., "CD39: A complementary target to immune checkpoints to counteract tumor-mediated immunosuppression", Oncolmmunology, Feb. 3, 2015, vol. 4, Issue 5, pp. e1003015-1-e1003015-2, XP055371480, DOI: 10.1080/2162402X.2014.1003015.
Anonymous, "Product Specification Anti-ENTPD2 Product Datasheet", Atlas Antibodies, Dec. 1, 2012, XP055623781, URL: https://www.atlasantibodies.com/api/print_datasheet/HPA017676.pdf.
MacCallum et al., 'Antibody-antigen Interactions: Contact Analysis and Binding Site Topography, J. Mol. Biol., Jan. 7, 1996, pp. 732-745, 262.

(Continued)

*Primary Examiner* — Adam Weidner
*Assistant Examiner* — Ashley H. Gao
(74) *Attorney, Agent, or Firm* — Seth E. Cockrum

(57) ABSTRACT

Provided herein are antibodies or antigen-binding fragments thereof, e.g., monoclonal antibodies or antigen binding fragments thereof, that specifically bind to ENTPD2 (e.g., human ENTPD2 protein), and methods of using these antibodies or antigen-binding fragments. The present invention also relates to combination therapies comprising an anti-human ENTPD2 antibody or antigen binding fragment and at least one additional therapeutic agent, and methods of using these combination therapies.

18 Claims, 27 Drawing Sheets

Specification includes a Sequence Listing.

(56) References Cited

OTHER PUBLICATIONS

Mariuzza et al., The Structural Basis of Antigen-Antibody Recognition, Ann. Rev. Biophs. Chem., 1987, pp. 139-159, vol. 16.
Ohno et al., "Antigen-binding specificities of antibodies are primarily determined by seven residues of VH", Proc. Natl. Acad. Sci. USA, May 1985, pp. 2945-2949, vol. 82.
Pakula et al., "Genetic Analysis of Protein Stability and Function", Annu. Rev. Genet., 1989, pp. 289-310, vol. 23.
Braganol et al., "Selective NTPDase2 expression modulates in vivo rat glioma growth", Cancer Sci., Aug. 2009, vol. 100, Issue 8, pp. 1434-1442, doi:10.1111/j.1349-7006.2009.01219.x.
Young et al., "Targeting cancer-derived adenosine: new therapeutic approaches", Cancer Discov., Aug. 2014, vol. 4, No. 8, pp. 879-888, doi: 10.1158/2159-8290.CD-14-0341.
Khvastunov et al., "Targeted therapy in oncology" Lekarstvenny Vestnik (Medicinal Bulletin), N4 (56), 2014, vol. 8, pp. 3-10.
Pelletier, et al., Generation and characterization of polyclonal and monoclonal antibodies to human NTPDase2 including a blocking antibody, Purinergic Signalling, Apr. 13, 2017, 293-304, 13.

\* cited by examiner

FIG. 1B

Table 20: ENTPD2 expression density across representative cancer cell lines

| Cell Line | Source | Indication | Receptor Density |
|---|---|---|---|
| CAL-148 | DSMZ (Germany) | Breast Adenocarcinoma | 111,726 |
| COR-L88 | ECACC (UK) | Small Cell Lung Cancer | 90,000 |
| RKO | ATCC (Manassas, VA) | Colorectal Cancer | 51,203 |
| LS-180 | ATCC (Manassas, VA) | Colorectal Cancer | 44,708 |
| SW948 | ATCC (Manassas, VA) | Colorectal Cancer | 41,576 |
| HT29 | ATCC (Manassas, VA) | Colorectal Cancer | 28,337 |
| KYSE-270 | DSMZ (Germany) | Esophageal Cancer | 28,273 |
| SNU-620 | KCLB (South Korea) | Stomach Adenocarcinoma | 19,646 |
| HCT 116 | ATCC (Manassas, VA) | Colorectal Cancer | 18,697 |
| SNU-16 | ATCC (Manassas, VA) | Gastic Carcinoma | 12,763 |

FIG. 3A

Heavy chain amino acid sequence of anti-human ENTPD2 FAb22 (SEQ ID NO: 330)

EVKLEQSGPGLVKPSQSLSLTCSVTGYSITSGYYWNWIRQFPGNKLEWMGYISYDGDNNYNPSLKNRISITRDTSKNQFF
\*                              \*   \*\*\*\*                             \*\* \*
LKLSSVTTEDTATYYCAGGYYRYGLSYYYVMDYWGQGTSVTVSAASTKGPSVFPLAPSSKSTSGGTAALGCLVKDYFPEP
                 \*\*\*\* \*\*   \*\*
VTVSWNSGALTSGVHTFPAVLQSSGLYSLSSVVTVPSSSLGTQTYICNVNHKPSNTKVDKRVEPKSC

Light chain amino acid sequence of anti-human ENTPD2 FAb22 (SEQ ID NO: 334)

DIKMTQSPASLAVSLGQRATISCKASQSVDYDGNSYMNWYQQKPGQPPKLLIYAASNLESGIPARFSGSGSGTDFTLNIH
                      \*\*\*  \*                              \*\*\*
PVEEEDAATYYCQQSNEDPPTFGGGTKLELKRTVAAPSVFIFPPSDEQLKSGTASVVCLLNNFYPREAKVQWKVDNALQS
         \*\* \*
GNSQESVTEQDSKDSTYSLSSTLTLSKADYEKHKVYACEVTHQGLSSPVTKSFNRGEC

FIG. 3B

Heavy chain amino acid sequence of anti-human ENTPD2 FAb23 (SEQ ID NO: 336)

EVQLQQPGAELVKPGASVKISCKASGYTFTDYNMDWVKQSHGKSLEWIGDINPKYDISTYNQQFKGKATLTVDKSSSTAY
                                                                                                                  * * *  *
MELRSLTSEDTAVYYCARRGFFLYYGINYYYFDVWGAGTTVTVSSASTKGPSVFPLAPSSKSTSGGTAALGCLVKDYFPEPVTVSW
                      * *** *
NSGALTSGVHTFPAVLQSSGLYSLSSVVTVPSSSLGTQTYICNVNHKPSNTKVDKRVEPKSC

Light chain amino acid sequence of anti-human ENTPD2 FAb23 (SEQ ID NO: 239)

QIVLTQSPAIMSASLGEEITLTCSASSSVSYIHWYQQKSGTSPTLLIYSTSNLASGVPSRFSGSGSGTFYSLTISSVEAE
*                      * *  *                         * *       ******
DAADYYCHQWSSYPWTFGGGTKLEIKRTVAAPSVFIFPPSDEQLKSGTASVVCLLNNFYPPEAKVQWKVDNALQSGNSQE
       **** *
SVTEQDSKDSTYSLSSTLTLSKADYEKHKVYACEVTHQGLSSPVTKSFNRGEC

FIG. 3C

Heavy chain amino acid sequence of anti-murine ENTPD2 FAb24 (SEQ ID NO: 338)

QVQLVQSGAELKKPGQSVKISCKASGYTFTHYGMNWVKQAPGQGLKWMGWINTDTGNPTYADDFKGRFVFSLDTSVSTAY
LQISNLKNEDTATYYCVRYGTLYSGYGFFFDSWGQGTLVTVSSASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKRVEPKSC

Light chain amino acid sequence of anti-murine ENTPD FAb24 (SEQ ID NO: 340)

DIMMTQSPSSLSVSAGEKATITCKSSQSLFNSNTNKNYLNWYLQKPGQSPKLLFYYASTRHTGVPDRFIGSGSGTDFTLT
ITSVQDEDLADYYCQQWYSYPWTFGPGTKLEIKRTVAAPSVFIFPPSDEQLKSGTASVVCLLNNFYPREAKVQWKVDNAL
QSGNSQESVTEQDSKDSTYSLSSTLTLSKADYEKHKVYACEVTHQGLSSPVTKSFNRGEC

FIG. 4A

```
                                                29   31              41              51
    MLVNQSRQG  PNKEHTGKMV  SAIVLYVLLA  AAAHSAFA TR   DVREPPALKY  GIVLDAGSSH  TSMFIYKWPA
 61         71          81          91         101         111         121
 DKENDTGIVG  QHSSCDVPGG  GISSYADNPS  GASQSLVGCL EQALQDVPKE  RHAGTPLYLG  ATAGMRLLNL
131         141         151         161        171         181         191
 TNPEASTSVL  MAVTHTLTQY  PFDFRGARIL  SGQEEGVFGW VTANYLLENF  IKYGWVGRWF  RPRKGTLGAM
201         211         221         231        241         251         261
 DLGGASTQIT  FETTSPAEDR  ASEVQLHLYG  QHYRVYTHSF LCYGRDQVLQ  RLLASALQTH  GFHPCWPRGF
271         281         291         301        311         321         331
 STQVLLGDVY  QSPCTMAQRP  QNFNSSARVS  LSGSSDPHLC RDLVSGLFSF  SSCPFSRCSF  NGVFQPPVAG
341         351         361         371        381         391         401
 NFVAFSAFFN  TVDFLRTSMG  LPVATLQQLE  AAAVNVCNQT WAQLQARVPG  QRARLADYCA  GAMFVQQLLS
411         421         431         441        451         461
 RGYGFDERAF  GGVIFQKKAA  DTAVGWALGY  MLNLTNLIPA DPPGLRKGTD  FS
```

FIG. 4B

```
                                           29 31         41            51
MLLVNQSHQG  FNKENTSKMV  GAIVLYVLLA  AAAHSAFATQ  DVREPPALKY  GIVLDAGSSH  TSMFVYKWPA
 61          71          81          91         101         111         121
DKENDTGIVG  QHSSCDVRGG  GISSYANDPS  RAGQSLVECL  EQALRDVPKD  RYASTPLYLG  ATAGMRLLNL
        ###
131         141         151         161         171         181         191
 TSPEATAKVL  EAVTQTLTRY  PFDFRGARIL  SGQDEGVFGW  VTANYLLENF  IKYGWVGRWI  RPRKGTLGAM
201         211         221         231         241         251         261
 DLGGASTQIT  FETTSPSEDP  DNEVHLRLYG  QHYRVYTHSF  LCYGRDQVLQ  RLLASALQIH  RFHPCWPKGY
271         281         291         301         311         321         331
 STQVLLREVY  QSPCTMGQRP  QTFNSSATVS  LSGTSNAALC  RDLVSGLFNI  SSCPFSQCSF  NGVFQPPVAG
341         351         361         371         381         391         401
 NFIAFSAFYY  TVDFLKTVMG  LPVGTLKQLE  DATETTCNQT  WAELQARVPG  QQTRLPDYCA  VAMFIHQLLS
     ## ## ## #                                ######  # ## #
411         421         431         441         451   α13  461
 RGYRFDERSF  RGVVFEKKAA  DTAVGWALGY  MLNLTNLIPA  DLPGLRKGTH  FS
```

ENTPD2 ANTIBODIES, COMBINATION THERAPIES, AND METHODS OF USING THE ANTIBODIES AND COMBINATION THERAPIES

CROSS-REFERENCE TO RELATED APPLICATIONS

This application is a national phase application, filed under 35 U.S.C. 371, of the International Patent Application No. PCT/IB2019/054422 filed May 29, 2019, which claims the benefit of U.S. Provisional Application No. 62/677,850 filed May 30, 2018, the content of which are hereby incorporated by reference in its entirety.

TECHNICAL FIELD

The present invention provides antibodies or antigen-binding fragments thereof, e.g., monoclonal antibodies or antigen binding fragments thereof, that specifically bind to the ectoenzyme ectonucleoside triphosphate diphosphohydrolase 2 (ENTPD2) and methods of using these antibodies or antigen-binding fragments.

The present invention also relates to combination therapies comprising an anti-human ENTPD2 antibody or antigen-binding fragment thereof and at least one additional therapeutic agent.

SEQUENCE LISTING

The instant application contains a Sequence Listing which has been submitted electronically in ASCII format and is hereby incorporated by reference in its entirety. Said ASCII copy, created on Apr. 5, 2019, is named PAT058145-WO-PCT_SL.txt and is 635,873 bytes in size.

BACKGROUND

Cellular stress and apoptosis trigger the release of ATP into the extracellular space. Increased ATP concentration promotes rapid inflammation, resulting in amplification of T-cell signaling, inhibiting regulatory T cells (Tregs), and promoting inflammasome activation in dendritic cells and macrophages. The ectoenzyme ectonucleoside triphosphate diphosphohydrolase 2 (ENTPD2) is part of the family of ecto-nucleosidases that hydrolyze 5'-triphosphates and is an integral membrane protein, which participates in purinergic signaling. ENTPD2 catalyzes the conversion of adenosine triphosphate (ATP) to adenosine diphosphate (ADP) and adenosine monophosphate (AMP). In turn, AMP is catalyzed by Cluster of Differentiation 73 (CD73), also known as ecto-5'-nucleotidase (ecto-5'NT), to adenosine. The molecule AMP interacts with several receptors, including the Adenosine A1, A2A, A2B, and A3 receptors. The A2A receptor has received particular attention due to its broad expression on immune cells. AMP has pleiotropic effects in the tumor microenvironment, including expansion of regulatory T cells (Tregs), inhibition of effector T cell (Teff) responses mediated by interferon (IFN)-γ, and expansion of myeloid derived suppressor cells (MDSCs). See, e.g., Allard B, et al., Curr Opin Pharmacol 29:7-16 (2016) and Allard D, et al., Immunotherapy 8:145-163 (2016).

In a mouse model of hepatocellular carcinoma it was shown that ENTPD2 converts extracellular ATP to AMP which prevents the differentiation of monocytic myeloid derived suppressor cells (MDSCs) to dendritic cells, therefore promoting the maintenance of MDSCs in vitro and in vivo (Chiu et al., Nat Commun. 8:517-28 (2017)).

ENTPD2 is expressed on cancer cells as described herein. New compositions and methods for regulating ENTPD2 activity and related therapeutic agents are highly desirable.

SUMMARY OF THE INVENTION

Provided herein are antibodies or antigen-binding fragments thereof, e.g., monoclonal antibodies or antigen-binding fragments thereof, that specifically bind to the ectoenzyme ectonucleoside triphosphate diphosphohydrolase 2 (ENTPD2). The ENTPD2 antibodies or antigen-binding fragments thereof are useful for treating ENTPD2-associated diseases, such as cancer.

In one aspect, provided herein are antibodies or antigen-binding fragments thereof that specifically bind to human ENTPD2 protein, wherein the antibody or antigen binding fragment thereof comprises a heavy chain complementarity determining region 1 (HCDR1), a heavy chain complementarity determining region 2 (HCDR2), a heavy chain complementarity determining region 3 (HCDR3), a light chain complementarity determining region 1 (LCDR1), a light chain complementarity determining region 2 (LCDR2), and a light chain complementarity determining region 3 (LCDR3) of any antibody or antigen binding fragment provided in Table 1. In some embodiments, the HCDR1, HCDR2, HCDR3, LCDR1, LCDR2, and LCDR3 of such antibodies or antigen binding fragments are selected from the HCDR1, HCDR2, HCDR3, LCDR1, LCDR2, and LCDR3 sequences provided in Table 1. In some embodiments, such antibodies or antigen binding fragments comprise a heavy chain variable region (VH) provided in Table 1. In some embodiments, such antibodies or antigen binding fragments comprise a light chain variable region (VL) provided in Table 1.

In another aspect, provided herein are antibodies or antigen binding fragments selected from any one of the following:
1) an antibody or antigen binding fragment thereof comprising:
   an HCDR1 sequence comprising SEQ ID NO: 1,
   an HCDR2 sequence comprising SEQ ID NO: 2,
   an HCDR3 sequence comprising SEQ ID NO: 3,
   an LCDR1 sequence comprising SEQ ID NO: 14,
   an LCDR2 sequence comprising SEQ ID NO: 15, and
   an LCDR3 sequence comprising SEQ ID NO: 16;
2) an antibody or antigen binding fragment thereof comprising:
   an HCDR1 sequence comprising SEQ ID NO: 4,
   an HCDR2 sequence comprising SEQ ID NO: 5,
   an HCDR3 sequence comprising SEQ ID NO: 3,
   an LCDR1 sequence comprising SEQ ID NO: 17,
   an LCDR2 sequence comprising SEQ ID NO: 18, and
   an LCDR3 sequence comprising SEQ ID NO: 19;
3) an antibody or antigen binding fragment thereof comprising:
   an HCDR1 sequence comprising SEQ ID NO: 7,
   an HCDR2 sequence comprising SEQ ID NO: 8,
   an HCDR3 sequence comprising SEQ ID NO: 9,
   an LCDR1 sequence comprising SEQ ID NO: 20,
   an LCDR2 sequence comprising SEQ ID NO: 18, and
   an LCDR3 sequence comprising SEQ ID NO: 16;
4) an antibody or antigen binding fragment thereof comprising:
   an HCDR1 sequence comprising SEQ ID NO: 37,
   an HCDR2 sequence comprising SEQ ID NO: 38, an HCDR3 sequence comprising SEQ ID NO: 39,
an LCDR1 sequence comprising SEQ ID NO: 50,
an LCDR2 sequence comprising SEQ ID NO: 51, and
an LCDR3 sequence comprising SEQ ID NO: 52;
5) an antibody or antigen binding fragment thereof comprising:
an HCDR1 sequence comprising SEQ ID NO: 40,
an HCDR2 sequence comprising SEQ ID NO: 41,
an HCDR3 sequence comprising SEQ ID NO: 39,
an LCDR1 sequence comprising SEQ ID NO: 53,
an LCDR2 sequence comprising SEQ ID NO: 54, and
an LCDR3 sequence comprising SEQ ID NO: 55;
6) an antibody or antigen binding fragment thereof comprising:
an HCDR1 sequence comprising SEQ ID NO: 43,
an HCDR2 sequence comprising SEQ ID NO: 44,
an HCDR3 sequence comprising SEQ ID NO: 45,
an LCDR1 sequence comprising SEQ ID NO: 56,
an LCDR2 sequence comprising SEQ ID NO: 54, and
an LCDR3 sequence comprising SEQ ID NO: 52;
7) an antibody or antigen binding fragment thereof comprising:
an HCDR1 sequence comprising SEQ ID NO: 37,
an HCDR2 sequence comprising SEQ ID NO: 38,
an HCDR3 sequence comprising SEQ ID NO: 39,
an LCDR1 sequence comprising SEQ ID NO: 61,
an LCDR2 sequence comprising SEQ ID NO: 51, and
an LCDR3 sequence comprising SEQ ID NO: 52;
8) an antibody or antigen binding fragment thereof comprising:
an HCDR1 sequence comprising SEQ ID NO: 40,
an HCDR2 sequence comprising SEQ ID NO: 41,
an HCDR3 sequence comprising SEQ ID NO: 39,
an LCDR1 sequence comprising SEQ ID NO: 62,
an LCDR2 sequence comprising SEQ ID NO: 54, and
an LCDR3 sequence comprising SEQ ID NO: 55;
9) an antibody or antigen binding fragment thereof comprising:
an HCDR1 sequence comprising SEQ ID NO: 43,
an HCDR2 sequence comprising SEQ ID NO: 44,
an HCDR3 sequence comprising SEQ ID NO: 45,
an LCDR1 sequence comprising SEQ ID NO: 63,
an LCDR2 sequence comprising SEQ ID NO: 54, and
an LCDR3 sequence comprising SEQ ID NO: 52;
10) an antibody or antigen binding fragment thereof comprising:
an HCDR1 sequence comprising SEQ ID NO: 37,
an HCDR2 sequence comprising SEQ ID NO: 38,
an HCDR3 sequence comprising SEQ ID NO: 68,
an LCDR1 sequence comprising SEQ ID NO: 50,
an LCDR2 sequence comprising SEQ ID NO: 51, and
an LCDR3 sequence comprising SEQ ID NO: 52;
11) an antibody or antigen binding fragment thereof comprising:
an HCDR1 sequence comprising SEQ ID NO: 40,
an HCDR2 sequence comprising SEQ ID NO: 41,
an HCDR3 sequence comprising SEQ ID NO: 68,
an LCDR1 sequence comprising SEQ ID NO: 53,
an LCDR2 sequence comprising SEQ ID NO: 54, and
an LCDR3 sequence comprising SEQ ID NO: 55;
12) an antibody or antigen binding fragment thereof comprising:
an HCDR1 sequence comprising SEQ ID NO: 43,
an HCDR2 sequence comprising SEQ ID NO: 44,
an HCDR3 sequence comprising SEQ ID NO: 69,
an LCDR1 sequence comprising SEQ ID NO: 56,
an LCDR2 sequence comprising SEQ ID NO: 54, and
an LCDR3 sequence comprising SEQ ID NO: 52;
13) an antibody or antigen binding fragment thereof comprising:
an HCDR1 sequence comprising SEQ ID NO: 82,
an HCDR2 sequence comprising SEQ ID NO: 83,
an HCDR3 sequence comprising SEQ ID NO: 84,
an LCDR1 sequence comprising SEQ ID NO: 95,
an LCDR2 sequence comprising SEQ ID NO: 96, and
an LCDR3 sequence comprising SEQ ID NO: 97;
14) an antibody or antigen binding fragment thereof comprising:
an HCDR1 sequence comprising SEQ ID NO: 85,
an HCDR2 sequence comprising SEQ ID NO: 86,
an HCDR3 sequence comprising SEQ ID NO: 84,
an LCDR1 sequence comprising SEQ ID NO: 98,
an LCDR2 sequence comprising SEQ ID NO: 99, and
an LCDR3 sequence comprising SEQ ID NO: 100;
15) an antibody or antigen binding fragment thereof comprising:
an HCDR1 sequence comprising SEQ ID NO: 88,
an HCDR2 sequence comprising SEQ ID NO: 89,
an HCDR3 sequence comprising SEQ ID NO: 90,
an LCDR1 sequence comprising SEQ ID NO: 101,
an LCDR2 sequence comprising SEQ ID NO: 99, and
an LCDR3 sequence comprising SEQ ID NO: 97;
16) an antibody or antigen binding fragment thereof comprising:
an HCDR1 sequence comprising SEQ ID NO: 106,
an HCDR2 sequence comprising SEQ ID NO: 107,
an HCDR3 sequence comprising SEQ ID NO: 108,
an LCDR1 sequence comprising SEQ ID NO: 119,
an LCDR2 sequence comprising SEQ ID NO: 120, and
an LCDR3 sequence comprising SEQ ID NO: 121;
17) an antibody or antigen binding fragment thereof comprising:
an HCDR1 sequence comprising SEQ ID NO: 109,
an HCDR2 sequence comprising SEQ ID NO: 110,
an HCDR3 sequence comprising SEQ ID NO: 108,
an LCDR1 sequence comprising SEQ ID NO: 122,
an LCDR2 sequence comprising SEQ ID NO: 99, and
an LCDR3 sequence comprising SEQ ID NO: 123;
18) an antibody or antigen binding fragment thereof comprising:
an HCDR1 sequence comprising SEQ ID NO: 112,
an HCDR2 sequence comprising SEQ ID NO: 113,
an HCDR3 sequence comprising SEQ ID NO: 114,
an LCDR1 sequence comprising SEQ ID NO: 124,
an LCDR2 sequence comprising SEQ ID NO: 99, and
an LCDR3 sequence comprising SEQ ID NO: 121;
19) an antibody or antigen binding fragment thereof comprising:
an HCDR1 sequence comprising SEQ ID NO: 106,
an HCDR2 sequence comprising SEQ ID NO: 129,
an HCDR3 sequence comprising SEQ ID NO: 108,
an LCDR1 sequence comprising SEQ ID NO: 119,
an LCDR2 sequence comprising SEQ ID NO: 120, and
an LCDR3 sequence comprising SEQ ID NO: 121;
20) an antibody or antigen binding fragment thereof comprising:
an HCDR1 sequence comprising SEQ ID NO: 109,
an HCDR2 sequence comprising SEQ ID NO: 130,
an HCDR3 sequence comprising SEQ ID NO: 108
an LCDR1 sequence comprising SEQ ID NO: 122,
an LCDR2 sequence comprising SEQ ID NO: 99, and
an LCDR3 sequence comprising SEQ ID NO: 123;

21) an antibody or antigen binding fragment thereof comprising:
an HCDR1 sequence comprising SEQ ID NO: 112,
an HCDR2 sequence comprising SEQ ID NO: 131,
an HCDR3 sequence comprising SEQ ID NO: 114,
an LCDR1 sequence comprising SEQ ID NO: 124,
an LCDR2 sequence comprising SEQ ID NO: 99, and
an LCDR3 sequence comprising SEQ ID NO: 121;
22) an antibody or antigen binding fragment thereof comprising:
an HCDR1 sequence comprising SEQ ID NO: 136,
an HCDR2 sequence comprising SEQ ID NO: 137,
an HCDR3 sequence comprising SEQ ID NO: 138,
an LCDR1 sequence comprising SEQ ID NO: 149,
an LCDR2 sequence comprising SEQ ID NO: 150, and
an LCDR3 sequence comprising SEQ ID NO: 151;
23) an antibody or antigen binding fragment thereof comprising:
an HCDR1 sequence comprising SEQ ID NO: 139,
an HCDR2 sequence comprising SEQ ID NO: 140,
an HCDR3 sequence comprising SEQ ID NO: 138,
an LCDR1 sequence comprising SEQ ID NO: 152,
an LCDR2 sequence comprising SEQ ID NO: 153, and
an LCDR3 sequence comprising SEQ ID NO: 154;
24) an antibody or antigen binding fragment thereof comprising:
an HCDR1 sequence comprising SEQ ID NO: 142,
an HCDR2 sequence comprising SEQ ID NO: 143,
an HCDR3 sequence comprising SEQ ID NO: 144,
an LCDR1 sequence comprising SEQ ID NO: 155,
an LCDR2 sequence comprising SEQ ID NO: 153, and
an LCDR3 sequence comprising SEQ ID NO: 151;
25) an antibody or antigen binding fragment thereof comprising:
an HCDR1 sequence comprising SEQ ID NO: 160,
an HCDR2 sequence comprising SEQ ID NO: 161,
an HCDR3 sequence comprising SEQ ID NO: 162,
an LCDR1 sequence comprising SEQ ID NO: 173,
an LCDR2 sequence comprising SEQ ID NO: 150, and
an LCDR3 sequence comprising SEQ ID NO: 174;
26) an antibody or antigen binding fragment thereof comprising:
an HCDR1 sequence comprising SEQ ID NO: 163,
an HCDR2 sequence comprising SEQ ID NO: 164,
an HCDR3 sequence comprising SEQ ID NO: 162,
an LCDR1 sequence comprising SEQ ID NO: 175,
an LCDR2 sequence comprising SEQ ID NO: 153, and
an LCDR3 sequence comprising SEQ ID NO: 176;
27) an antibody or antigen binding fragment thereof comprising:
an HCDR1 sequence comprising SEQ ID NO: 166,
an HCDR2 sequence comprising SEQ ID NO: 167,
an HCDR3 sequence comprising SEQ ID NO: 168,
an LCDR1 sequence comprising SEQ ID NO: 177,
an LCDR2 sequence comprising SEQ ID NO: 153, and
an LCDR3 sequence comprising SEQ ID NO: 174;
28) an antibody or antigen binding fragment thereof comprising:
an HCDR1 sequence comprising SEQ ID NO: 37,
an HCDR2 sequence comprising SEQ ID NO: 220,
an HCDR3 sequence comprising SEQ ID NO: 221,
an LCDR1 sequence comprising SEQ ID NO: 61,
an LCDR2 sequence comprising SEQ ID NO: 51, and
an LCDR3 sequence comprising SEQ ID NO: 52;
29) an antibody or antigen binding fragment thereof comprising:
an HCDR1 sequence comprising SEQ ID NO: 40,
an HCDR2 sequence comprising SEQ ID NO: 222,
an HCDR3 sequence comprising SEQ ID NO: 221,
an LCDR1 sequence comprising SEQ ID NO: 62,
an LCDR2 sequence comprising SEQ ID NO: 54, and
an LCDR3 sequence comprising SEQ ID NO: 55;
30) an antibody or antigen binding fragment thereof comprising:
an HCDR1 sequence comprising SEQ ID NO: 43,
an HCDR2 sequence comprising SEQ ID NO: 223,
an HCDR3 sequence comprising SEQ ID NO: 224,
an LCDR1 sequence comprising SEQ ID NO: 63,
an LCDR2 sequence comprising SEQ ID NO: 54, and
an LCDR3 sequence comprising SEQ ID NO: 52;
31) an antibody or antigen binding fragment thereof comprising:
an HCDR1 sequence comprising SEQ ID NO: 37,
an HCDR2 sequence comprising SEQ ID NO: 220,
an HCDR3 sequence comprising SEQ ID NO: 68,
an LCDR1 sequence comprising SEQ ID NO: 61,
an LCDR2 sequence comprising SEQ ID NO: 51, and
an LCDR3 sequence comprising SEQ ID NO: 52;
32) an antibody or antigen binding fragment thereof comprising:
an HCDR1 sequence comprising SEQ ID NO: 40,
an HCDR2 sequence comprising SEQ ID NO: 222,
an HCDR3 sequence comprising SEQ ID NO: 68,
an LCDR1 sequence comprising SEQ ID NO: 62,
an LCDR2 sequence comprising SEQ ID NO: 54, and
an LCDR3 sequence comprising SEQ ID NO: 55;
33) an antibody or antigen binding fragment thereof comprising:
an HCDR1 sequence comprising SEQ ID NO: 43,
an HCDR2 sequence comprising SEQ ID NO: 223,
an HCDR3 sequence comprising SEQ ID NO: 69,
an LCDR1 sequence comprising SEQ ID NO: 63,
an LCDR2 sequence comprising SEQ ID NO: 54, and
an LCDR3 sequence comprising SEQ ID NO: 52;
34) an antibody or antigen binding fragment thereof comprising:
an HCDR1 sequence comprising SEQ ID NO: 1,
an HCDR2 sequence comprising SEQ ID NO: 245,
an HCDR3 sequence comprising SEQ ID NO: 246,
an LCDR1 sequence comprising SEQ ID NO: 254,
an LCDR2 sequence comprising SEQ ID NO: 15, and
an LCDR3 sequence comprising SEQ ID NO: 255;
35) an antibody or antigen binding fragment thereof comprising:
an HCDR1 sequence comprising SEQ ID NO: 4,
an HCDR2 sequence comprising SEQ ID NO: 247,
an HCDR3 sequence comprising SEQ ID NO: 246,
an LCDR1 sequence comprising SEQ ID NO: 17,
an LCDR2 sequence comprising SEQ ID NO: 18, and
an LCDR3 sequence comprising SEQ ID NO: 256;
36) an antibody or antigen binding fragment thereof comprising:
an HCDR1 sequence comprising SEQ ID NO: 7,
an HCDR2 sequence comprising SEQ ID NO: 248,
an HCDR3 sequence comprising SEQ ID NO: 249,
an LCDR1 sequence comprising SEQ ID NO: 20,
an LCDR2 sequence comprising SEQ ID NO: 18, and
an LCDR3 sequence comprising SEQ ID NO: 255;
37) an antibody or antigen binding fragment thereof comprising:
an HCDR1 sequence comprising SEQ ID NO: 1,
an HCDR2 sequence comprising SEQ ID NO: 261,
an HCDR3 sequence comprising SEQ ID NO: 262,
an LCDR1 sequence comprising SEQ ID NO: 254, an LCDR2 sequence comprising SEQ ID NO: 15, and
an LCDR3 sequence comprising SEQ ID NO: 16;
38) an antibody or antigen binding fragment thereof comprising:
an HCDR1 sequence comprising SEQ ID NO: 4,
an HCDR2 sequence comprising SEQ ID NO: 247,
an HCDR3 sequence comprising SEQ ID NO: 262,
an LCDR1 sequence comprising SEQ ID NO: 17,
an LCDR2 sequence comprising SEQ ID NO: 18, and
an LCDR3 sequence comprising SEQ ID NO: 19;
39) an antibody or antigen binding fragment thereof comprising:
an HCDR1 sequence comprising SEQ ID NO: 7,
an HCDR2 sequence comprising SEQ ID NO: 248,
an HCDR3 sequence comprising SEQ ID NO: 263,
an LCDR1 sequence comprising SEQ ID NO: 20,
an LCDR2 sequence comprising SEQ ID NO: 18, and
an LCDR3 sequence comprising SEQ ID NO: 16;
40) an antibody or antigen binding fragment thereof comprising:
an HCDR1 sequence comprising SEQ ID NO: 272,
an HCDR2 sequence comprising SEQ ID NO: 273,
an HCDR3 sequence comprising SEQ ID NO: 274,
an LCDR1 sequence comprising SEQ ID NO: 254,
an LCDR2 sequence comprising SEQ ID NO: 285, and
an LCDR3 sequence comprising SEQ ID NO: 16;
41) an antibody or antigen binding fragment thereof comprising:
an HCDR1 sequence comprising SEQ ID NO: 275,
an HCDR2 sequence comprising SEQ ID NO: 276,
an HCDR3 sequence comprising SEQ ID NO: 274,
an LCDR1 sequence comprising SEQ ID NO: 17,
an LCDR2 sequence comprising SEQ ID NO: 286, and
an LCDR3 sequence comprising SEQ ID NO: 19;
42) an antibody or antigen binding fragment thereof comprising:
an HCDR1 sequence comprising SEQ ID NO: 278,
an HCDR2 sequence comprising SEQ ID NO: 279,
an HCDR3 sequence comprising SEQ ID NO: 280,
an LCDR1 sequence comprising SEQ ID NO: 20,
an LCDR2 sequence comprising SEQ ID NO: 286, and
an LCDR3 sequence comprising SEQ ID NO: 16.

In another aspect, provided herein are antibodies or antigen binding fragments selected from any one of the following:
1) an antibody or antigen binding fragment thereof comprising a VH comprising SEQ ID NO: 10 or a sequence at least about 95% or more identical thereto, and a VL comprising SEQ ID NO: 21 or a sequence at least about 95% or more identical thereto;
2) an antibody or antigen binding fragment thereof comprising a VH comprising SEQ ID NO: 25 or a sequence at least about 95% or more identical thereto, and a VL comprising SEQ ID NO: 29 or a sequence at least about 95% or more identical thereto;
3) an antibody or antigen binding fragment thereof comprising a VH comprising SEQ ID NO: 33 or a sequence at least about 95% or more identical thereto, and a VL comprising SEQ ID NO: 29 or a sequence at least about 95% or more identical thereto;
4) an antibody or antigen binding fragment thereof comprising a VH comprising SEQ ID NO: 46 or a sequence at least about 95% or more identical thereto, and a VL comprising SEQ ID NO: 57 or a sequence at least about 95% or more identical thereto;
5) an antibody or antigen binding fragment thereof comprising a VH comprising SEQ ID NO: 46 or a sequence at least about 95% or more identical thereto, and a VL comprising SEQ ID NO: 64 or a sequence at least about 95% or more identical thereto;
6) an antibody or antigen binding fragment thereof comprising a VH comprising SEQ ID NO: 70 or a sequence at least about 95% or more identical thereto, and a VL comprising SEQ ID NO: 74 or a sequence at least about 95% or more identical thereto;
7) an antibody or antigen binding fragment thereof comprising a VH comprising SEQ ID NO: 25 or a sequence at least about 95% or more identical thereto, and a VL comprising SEQ ID NO: 78 or a sequence at least about 95% or more identical thereto;
8) an antibody or antigen binding fragment thereof comprising a VH comprising SEQ ID NO: 91 or a sequence at least about 95% or more identical thereto, and a VL comprising SEQ ID NO: 102 or a sequence at least about 95% or more identical thereto;
9) an antibody or antigen binding fragment thereof comprising a VH comprising SEQ ID NO: 115 or a sequence at least about 95% or more identical thereto, and a VL comprising SEQ ID NO: 125 or a sequence at least about 95% or more identical thereto;
10) an antibody or antigen binding fragment thereof comprising a VH comprising SEQ ID NO: 132 or a sequence at least about 95% or more identical thereto, and a VL comprising SEQ ID NO: 125 or a sequence at least about 95% or more identical thereto;
11) an antibody or antigen binding fragment thereof comprising a VH comprising SEQ ID NO: 145 or a sequence at least about 95% or more identical thereto, and a VL comprising SEQ ID NO: 156 or a sequence at least about 95% or more identical thereto;
12) an antibody or antigen binding fragment thereof comprising a VH comprising SEQ ID NO: 169 or a sequence at least about 95% or more identical thereto, and a VL comprising SEQ ID NO: 178 or a sequence at least about 95% or more identical thereto;
13) an antibody or antigen binding fragment thereof comprising a VH comprising SEQ ID NO: 225 or a sequence at least about 95% or more identical thereto, and a VL comprising SEQ ID NO: 229 or a sequence at least about 95% or more identical thereto;
14) an antibody or antigen binding fragment thereof comprising a VH comprising SEQ ID NO: 233 or a sequence at least about 95% or more identical thereto, and a VL comprising SEQ ID NO: 237 or a sequence at least about 95% or more identical thereto;
15) an antibody or antigen binding fragment thereof comprising a VH comprising SEQ ID NO: 241 or a sequence at least about 95% or more identical thereto, and a VL comprising SEQ ID NO: 229 or a sequence at least about 95% or more identical thereto;
16) an antibody or antigen binding fragment thereof comprising a VH comprising SEQ ID NO: 250 or a sequence at least about 95% or more identical thereto, and a VL comprising SEQ ID NO: 257 or a sequence at least about 95% or more identical thereto;
17) an antibody or antigen binding fragment thereof comprising a VH comprising SEQ ID NO: 264 or a sequence at least about 95% or more identical thereto, and a VL comprising SEQ ID NO: 268 or a sequence at least about 95% or more identical thereto; or
18) an antibody or antigen binding fragment thereof comprising a VH comprising SEQ ID NO: 281 or a sequence at least about 95% or more identical thereto, and a VL comprising SEQ ID NO: 287 or a sequence at least about 95% or more identical thereto.

In another aspect, provided herein are antibodies or antigen binding fragments selected from any one of the following:

1) an antibody comprising a heavy chain comprising SEQ ID NO: 12 or a sequence at least about 95% or more identical thereto, and a light chain comprising SEQ ID NO: 23 or a sequence at least about 95% or more identical thereto;
2) an antibody comprising a heavy chain comprising SEQ ID NO: 27 or a sequence at least about 95% or more identical thereto, and a light chain comprising SEQ ID NO: 31 or a sequence at least about 95% or more identical thereto;
3) an antibody comprising a heavy chain comprising SEQ ID NO: 35 or a sequence at least about 95% or more identical thereto, and a light chain comprising SEQ ID NO: 31 or a sequence at least about 95% or more identical thereto;
4) an antibody comprising a heavy chain comprising SEQ ID NO: 48 or a sequence at least about 95% or more identical thereto, and a light chain comprising SEQ ID NO: 59 or a sequence at least about 95% or more identical thereto;
5) an antibody comprising a heavy chain comprising SEQ ID NO: 48 or a sequence at least about 95% or more identical thereto, and a light chain comprising SEQ ID NO: 66 or a sequence at least about 95% or more identical thereto;
6) an antibody comprising a heavy chain comprising SEQ ID NO: 72 or a sequence at least about 95% or more identical thereto, and a light chain comprising SEQ ID NO: 76 or a sequence at least about 95% or more identical thereto;
7) an antibody comprising a heavy chain comprising SEQ ID NO: 27 or a sequence at least about 95% or more identical thereto, and a light chain comprising SEQ ID NO: 80 or a sequence at least about 95% or more identical thereto;
8) an antibody comprising a heavy chain comprising SEQ ID NO: 93 or a sequence at least about 95% or more identical thereto, and a light chain comprising SEQ ID NO: 104 or a sequence at least about 95% or more identical thereto;
9) an antibody comprising a heavy chain comprising SEQ ID NO: 117 or a sequence at least about 95% or more identical thereto, and a light chain comprising SEQ ID NO: 127 or a sequence at least about 95% or more identical thereto;
10) an antibody comprising a heavy chain comprising SEQ ID NO: 134 or a sequence at least about 95% or more identical thereto, and a light chain comprising SEQ ID NO: 127 or a sequence at least about 95% or more identical thereto;
11) an antibody comprising a heavy chain comprising SEQ ID NO: 147 or a sequence at least about 95% or more identical thereto, and a light chain comprising SEQ ID NO: 158 or a sequence at least about 95% or more identical thereto;
12) an antibody comprising a heavy chain comprising SEQ ID NO: 171 or a sequence at least about 95% or more identical thereto, and a light chain comprising SEQ ID NO: 180 or a sequence at least about 95% or more identical thereto;
13) an antibody comprising a heavy chain comprising SEQ ID NO: 227 or a sequence at least about 95% or more identical thereto, and a light chain comprising SEQ ID NO: 231 or a sequence at least about 95% or more identical thereto;
14) an antibody comprising a heavy chain comprising SEQ ID NO: 235 or a sequence at least about 95% or more identical thereto, and a light chain comprising SEQ ID NO: 239 or a sequence at least about 95% or more identical thereto;
15) an antibody comprising a heavy chain comprising SEQ ID NO: 243 or a sequence at least about 95% or more identical thereto, and a light chain comprising SEQ ID NO: 231 or a sequence at least about 95% or more identical thereto;
16) an antibody comprising a heavy chain comprising SEQ ID NO: 252 or a sequence at least about 95% or more identical thereto, and a light chain comprising SEQ ID NO: 259 or a sequence at least about 95% or more identical thereto;
17) an antibody comprising a heavy chain comprising SEQ ID NO: 266 or a sequence at least about 95% or more identical thereto, and a light chain comprising SEQ ID NO: 270 or a sequence at least about 95% or more identical thereto; or
18) an antibody comprising a heavy chain comprising SEQ ID NO: 283 or a sequence at least about 95% or more identical thereto, and a light chain comprising SEQ ID NO: 289 or a sequence at least about 95% or more identical thereto.

Provided herein are also antibodies or antigen binding fragments thereof that specifically bind to an epitope in human ENTPD2, wherein the epitope comprises at least one (e.g., at least two, at least three, at least four, at least five, at least six, at least seven, at least eight, at least nine, at least ten, at least eleven, at least twelve, at least thirteen, at least fourteen, at least fifteen, at least twenty) of the following residues: His50, Asp76, Pro78, Gly79, Gly80, Tyr85, Asp87, Asn88, Gly91, Gln94, Ser95, Gly98, Glu101, Gln102, Gln105, Asp106, Arg245, Thr272, Gln273, Leu275, Asp278, Arg298, Ala347, Ala350, Thr351, Arg392, Ala393, Arg394, or Tyr398.

Provided herein are also antibodies or antigen binding fragments thereof that specifically bind to an epitope in human ENTPD2, wherein the epitope comprises at least one (e.g., at least two, at least three, at least four, at least five, at least six, at least seven, at least eight, at least nine, at least ten, at least eleven, at least twelve, at least thirteen, at least fourteen, at least fifteen, at least twenty) of the following residues: Gly79, Gln250, Leu253, Trp266, Arg268, Gly269, Phe270, Ser271, Thr272, Gln273, Val274, Leu275, Asp278, Arg298, Ser300, Ser302, Gly303, Thr380, Trp381, Ala382, Gly390, Gln391, Arg392, Ala393, Arg394, or Asp397.

In some embodiments, the antibodies or antigen binding fragments thereof described herein have an IgG1, IgG2, IgG3 or IgG4 isotype. In some embodiments, the antibodies or antigen binding fragments thereof described herein have an IgG1 isotype. In some embodiments, the antibodies or antigen binding fragments thereof described herein comprise an Fc region selected from an IgG1 Fc region, an IgG2 Fc region, an IgG4 Fc region, or an IgG2/IgG4 hybrid Fc region. In some embodiments, the antibodies or antigen binding fragments thereof described herein comprise an Fc region selected from an IgG1 Fc region. In some embodiments, the antibodies or antigen binding fragments thereof described herein comprise a modified Fc region. In some embodiments, the antibodies or antigen binding fragments thereof described herein comprise a modified Fc region having reduced antibody-dependent cellular cytotoxicity (ADCC) or complement-dependent cytotoxicity (CDC) activity compared to the parent antibody.

In another aspect, provided herein are antibodies or antigen binding fragments thereof that compete with any antibody or antigen binding fragment provided in Table 1 for binding to human ENTPD2 protein.

In another aspect, provided herein are antibodies or antigen binding fragments thereof that bind essentially the same ENTPD2 epitope as any antibody or antigen binding fragment provided in Table 1.

In some embodiments, the antibodies or antigen binding fragments thereof described herein bind to human ENTPD2 protein with a dissociation constant (KD) of less than 10 nM, e.g., with a KD of less than 5 nM, or with a KD of less than 3 nM, e.g., as measured by Biacore™. In some embodiments, the dissociation constant of the antibodies or antigen binding fragments thereof described herein to human ENTPD2 is measured by Biacore™ at 25° C.

In some embodiments, the antibodies or antigen binding fragments thereof described herein inhibit human ENTPD2 enzymatic activity by at least 40%, at least 50%, at least 60%, at least 70%, at least 80%, or at least 90%. In some embodiments, the enzymatic activity of human ENTPD2 is measured using an in vitro FRET assay which measures the hydrolysis of ATP to ADP by either recombinant ENTPD2 or ENTPD2 expressed on the surface of cells.

In some embodiments, the anti-human ENTPD2 antibodies or antigen binding fragments thereof described herein inhibit ENTPD2's ability of hydrolysis of adenosine triphosphate (ATP). In some embodiments, ENTPD2's ability of hydrolysis of ATP is measured using an in vitro FRET assay which measures the hydrolysis of ATP to ADP by either recombinant ENTPD2 or ENTPD2 expressed on the surface of cells.

In some embodiments, the anti-human ENTPD2 antibodies or antigen binding fragments thereof described herein interfere with ATP binding to ENTPD2 or trap ATP within the catalytic domain of ENTPD2. In some embodiments, ENTPD2's ability of hydrolysis of ATP is measured using an in vitro FRET assay which measures the hydrolysis of ATP to ADP by either recombinant ENTPD2 or ENTPD2 expressed on the surface of cells.

In some embodiments, the antibodies or antigen binding fragments thereof described herein are human or humanized antibodies or fragments thereof.

In another aspect, provided herein are nucleic acids encoding an anti-human ENTPD2 antibody or antigen binding fragment thereof described herein. Such nucleic acids can encode polypeptides comprising segments or domains of the ENTPD2 antibodies or antigen binding fragments thereof described herein.

Also provided are vectors comprising such nucleic acids encoding an anti-human ENTPD2 antibody or antigen binding fragment thereof described herein. In some embodiments, the vector is selected from a DNA vector, a RNA vector, a plasmid, a cosmid, or a viral vector. In some embodiments, the vector is a viral vector based on any one of the following viruses: lentivirus, adenovirus, adeno-associated virus (AAV), Herpes Simplex Virus (HSV), parvovirus, retrovirus, vaccinia virus, Sinbis virus, influenza virus, reovirus, Newcastle disease virus (NDV), measles virus, vesicular stomatitis virus (VSV), poliovirus, poxvirus, Seneca Valley virus, coxsackievirus, enterovirus, myxoma virus, or maraba virus. In some embodiments, the vector is an AAV vector. In some embodiments, the vector is a lentiviral vector. In some embodiments, the vector further comprises a promoter, e.g., a tissue-specific promoter. In some embodiments, the vector further comprises a detectable marker.

Also provided herein are cells comprising a nucleic acid or set of nucleic acids encoding an anti-human ENTPD2 antibody or antigen binding fragment thereof described herein or a vector comprising such a nucleic acid or set of nucleic acids.

In another aspect, provided herein are pharmaceutical compositions comprising an anti-human ENTPD2 antibody or antigen binding fragment thereof described herein, a nucleic acid encoding such an antibody or antigen binding fragment, a vector comprising such a nucleic acid or set of nucleic acids, or a cell comprising a nucleic acid or sets of nucleic acids or vector described herein, and a pharmaceutically acceptable carrier.

In another aspect, provided herein are methods of producing an anti-human ENTPD2 antibody or antigen binding fragment thereof by culturing a cell comprising a nucleic acid or sets of nucleic acids encoding an anti-human ENTPD2 antibody or antigen binding fragment thereof or a vector comprising such a nucleic acid or sets of nucleic acids, and collecting the antibody or antigen binding fragment thereof from the culture medium.

In another aspect, provided herein are methods of treating a cancer in a subject in need thereof by administering to the subject a therapeutically effective amount of an anti-human ENTPD2 antibody or antigen binding fragment described herein, a nucleic acid or sets of nucleic acids encoding such an antibody or antigen binding fragment, a vector comprising a nucleic acid encoding such an antibody or antigen binding fragment, a cell comprising such a nucleic acid or sets of nucleic acids or vector, or a pharmaceutical composition comprising such an antibody or antigen binding fragment, nucleic acid or sets of nucleic acids, vector or cell. In some embodiments, the antibody or antigen binding fragment thereof, the nucleic acid or sets of nucleic acids, the vector, the cell, or the pharmaceutical composition, is administered to the subject through an intravenous, intratumoral or subcutaneous route.

In another aspect, provided herein are methods of stimulating an immune response in a subject by administering to the subject an anti-human ENTPD2 antibody or antigen binding fragment described herein, a nucleic acid or sets of nucleic acids encoding such an antibody or antigen binding fragment, a vector comprising a nucleic acid encoding such an antibody or antigen binding fragment, a cell comprising such a nucleic acid or sets of nucleic acids or vector, or a pharmaceutical composition comprising such an antibody or antigen binding fragment, nucleic acid or sets of nucleic acids, vector or cell, in an amount effective to stimulate the immune response.

In some embodiments, such methods can further include administration of at least one additional therapeutic agent to the subject.

In some embodiments, such methods can further include administration of at least two additional therapeutic agents to the subject.

In another aspect, provided herein is an antibody or antigen binding fragment thereof described herein, the nucleic acid or set of nucleic acids encoding such an antibody or antigen binding fragment thereof, a vector or a cell comprising such a nucleic acid or set of nucleic acids, or a pharmaceutical composition comprising such an antibody or antigen binding fragment thereof, nucleic acid or set of nucleic acids, vector, or cell, for use as a medicament.

In another aspect, provided herein is an antibody or antigen binding fragment thereof described herein, the nucleic acid encoding such an antibody or antigen binding fragment thereof, a vector or a cell comprising such a nucleic acid or set of nucleic acids, or a pharmaceutical composition comprising such an antibody or antigen binding fragment thereof, nucleic acid or set of nucleic acids, vector, or cell, for use in treatment of a cancer.

In another aspect, provided herein is a pharmaceutical composition comprising an antibody or antigen binding fragment thereof described herein, and at least one additional therapeutic agent or procedure.

In some embodiments, the at least one additional therapeutic agent or procedure is selected from one or more of chemotherapy, a targeted anti-cancer therapy, an oncolytic drug, a cytotoxic agent, an immune-based therapy, a cytokine, surgical procedure, a radiation procedure, an activator of a costimulatory molecule, an inhibitor of an inhibitory molecule, a vaccine, or a cell therapy.

In some embodiments, the at least one additional therapeutic agent is a PD-1 inhibitor, e.g., a PD-1 antibody. In some embodiments, the PD-1 inhibitor is selected from PDR001, Nivolumab, Pembrolizumab, Pidilizumab, MEDI0680, REGN2810, TSR-042, PF-06801591, or AMP-224.

In some embodiments, the at least one additional therapeutic agent is a PD-L1 inhibitor, e.g., a PD-L1 antibody. In some embodiments, the PD-L1 inhibitor is selected from FAZ053, Atezolizumab, Avelumab, Durvalumab, or BMS-936559.

In some embodiments, the at least one additional therapeutic agent is an A2AR antagonist. In some embodiments, the A2AR antagonist is selected from:
  i. an anti-CD73 antibody molecule, or antigen-binding fragment thereof, optionally wherein the anti-CD73 antibody is selected from:
    a. an anti-CD73 antibody molecule comprising a heavy chain variable region comprising the amino acid sequence of SEQ ID NO: 295 and a light chain variable region comprising the amino acid sequence of SEQ ID NO: 296, or an amino acid sequence at least 85%, 90%, 95% identical or higher to SEQ ID NO: 295 or 296;
    b. an anti-CD73 antibody molecule comprising a heavy chain variable region comprising the amino acid sequence of SEQ ID NO: 299 and a light chain variable region comprising the amino acid sequence of SEQ ID NO: 300, or an amino acid sequence at least 85%, 90%, 95% identical or higher to SEQ ID NO: 299 or 300;
    c. an anti-CD73 antibody molecule comprising a heavy chain variable region comprising the amino acid sequence of SEQ ID NO: 302 and a light chain variable region comprising the amino acid sequence of SEQ ID NO: 303, or an amino acid sequence at least 85%, 90%, 95% identical or higher to SEQ ID NO: 302 or 303;
    d. an anti-CD73 antibody molecule comprising a heavy chain variable region comprising the amino acid sequence of SEQ ID NO: 304 and a light chain variable region comprising the amino acid sequence of SEQ ID NO: 305, or an amino acid sequence at least 85%, 90%, 95% identical or higher to SEQ ID NO: 304 or 305;
    e. an anti-CD73 antibody molecule comprising a heavy chain variable region comprising the amino acid sequence of SEQ ID NO: 306 and a light chain variable region comprising the amino acid sequence of SEQ ID NO: 307, or an amino acid sequence at least 85%, 90%, 95% identical or higher to SEQ ID NO: 306 or 307; or
    f. an anti-CD73 antibody molecule comprising a heavy chain variable region comprising the amino acid sequence of SEQ ID NO: 308 and a light chain variable region comprising the amino acid sequence of SEQ ID NO: 309, or an amino acid sequence at least 85%, 90%, 95% identical or higher to SEQ ID NO: 308 or 309; or
  ii. PBF509/NIR178, CPI444/V81444, AZD4635/HTL-1071, Vipadenant, GBV-2034, AB928, Theophylline, Istradefylline, Tozadenant/SYN-115, KW-6356, ST-4206, and Preladenant/SCH 420814; or
  iii. 5-bromo-2,6-di-(1H-pyrazol-1-yl)pyrimidine-4-amine, or a pharmaceutically acceptable salt thereof; (S)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof; (R)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or racemate thereof, or a pharmaceutically acceptable salt thereof; 7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof, and 6-(2-chloro-6-methylpyridin-4-yl)-5-(4-fluorophenyl)-1,2,4-triazin-3-amine, or a pharmaceutically acceptable salt thereof.

In some embodiments, the at least one additional therapeutic agent is selected from:
  i. a CTLA-4 inhibitor, optionally wherein the CTLA-4 inhibitor is selected from Ipilimumab or Tremelimumab;
  ii. a TIM-3 inhibitor, optionally wherein the TIM-3 inhibitor is selected from MBG453, TSR-022, or LY3321367;
  iii. a LAG-3 inhibitor, optionally wherein the LAG-3 inhibitor is selected from LAG525, BMS-986016, TSR-033, MK-4280 or REGN3767;
  iv. a GITR agonist, optionally wherein the GITR agonist is selected from GWN323, BMS-986156, MK-4166, MK-1248, TRX518, INCAGN1876, AMG 228, or INBRX-110;
  v. an anti-CD3 multispecific antibody molecule, optionally wherein the anti-CD3 multispecific antibody molecule is an anti-CD3×anti-CD123 bispecific antibody molecule (e.g., XENP14045), or an anti-CD3×anti-CD20 bispecific antibody molecule (e.g., XENP13676);
  vi. a cytokine molecule, optionally wherein the cytokine molecule is IL-15 complexed with a soluble form of IL-15 receptor alpha (IL-15Ra);
  vii. a macrophage colony-stimulating factor (M-CSF) inhibitor, optionally wherein the M-CSF inhibitor is MCS110;
  viii. a CSF-1R inhibitor, optionally wherein the CSF-1R inhibitor is BLZ945;
  ix. an inhibitor of indoleamine 2,3-dioxygenase (IDO) and/or tryptophan 2,3-dioxygenase (TDO);
  x. a TGF-β inhibitor;
  xi. an oncolytic virus;
  xii. a chimeric antigen receptor (CAR) T-cell therapy.

In some embodiments, the at least one additional therapeutic agent is selected from: 1) a protein kinase C (PKC) inhibitor; 2) a heat shock protein 90 (HSP90) inhibitor; 3) an inhibitor of a phosphoinositide 3-kinase (PI3K) and/or target of rapamycin (mTOR); 4) an inhibitor of cytochrome P450 (e.g., a CYP17 inhibitor or a 17alpha-Hydroxylase/C17-20 Lyase inhibitor); 5) an iron chelating agent; 6) an aromatase inhibitor; 7) an inhibitor of p53, e.g., an inhibitor of a p53/Mdm2 interaction; 8) an apoptosis inducer; 9) an angiogenesis inhibitor; 10) an aldosterone synthase inhibitor; 11) a smoothened (SMO) receptor inhibitor; 12) a prolactin receptor (PRLR) inhibitor; 13) a Wnt signaling inhibitor; 14) a CDK4/6 inhibitor; 15) a fibroblast growth factor receptor 2 (FGFR2)/fibroblast growth factor receptor 4 (FGFR4) inhibitor; 16) an inhibitor of macrophage colony-stimulating factor (M-CSF); 17) an inhibitor of one or more of c-KIT, histamine release, Flt3 (e.g., FLK2/STK1) or PKC; 18) an inhibitor of one or more of VEGFR-2 (e.g., FLK-1/KDR), PDGFRbeta, c-KIT or Raf kinase C; 19) a somatostatin agonist and/or a growth hormone release inhibitor; 20) an anaplastic lymphoma kinase (ALK) inhibitor; 21) an insulin-like growth factor 1 receptor (IGF-1R) inhibitor; 22) a P-Glycoprotein 1 inhibitor; 23) a vascular endothelial growth factor receptor (VEGFR) inhibitor; 24) a BCR-ABL kinase inhibitor; 25) an FGFR inhibitor; 26) an inhibitor of CYP11B2; 27) a HDM2 inhibitor, e.g., an inhibitor of the HDM2-p53 interaction; 28) an inhibitor of a tyrosine kinase; 29) an inhibitor of c-MET; 30) an inhibitor of JAK; 31) an inhibitor of DAC; 32) an inhibitor of 11β-hydroxylase; 33) an inhibitor of IAP; 34) an inhibitor of PIM kinase; 35) an inhibitor of Porcupine; 36) an inhibitor of BRAF, e.g., BRAF V600E or wild-type BRAF; 37) an inhibitor of HERS; 38) an inhibitor of MEK; 39) an inhibitor of a lipid kinase; or one or more agents as provided in Table 16.

In some embodiments, the antibody or antigen binding fragment, the nucleic acid or set of nucleic acids, the vector, the cell, or the pharmaceutical composition is administered concurrently with, prior to, or subsequent to, the at least one additional therapeutic agent.

In some embodiments, administering the antibody or antigen binding fragment of, the nucleic acid or set of nucleic acids, the vector, the cell, or the pharmaceutical composition has one or more of the following effects:
(a) increased number of CD45+ CD4− CD8+ CD69+ CD25+ cells in a tumor or lesion site in the subject;
(b) increased number of CD45+ CD8− CD4+ FOXP3− CD69+ CD25+ cells in a tumor or lesion site in the subject;
(c) descreased plasma MCP1 or IL-1β level in the subject; or
(d) increased MCP1 level in a tumor or lesion site in the subject.

In another aspect, provided herein are use of an antibody or antigen binding fragment thereof described herein, the nucleic acid encoding such an antibody or antigen binding fragment thereof, a vector or a cell comprising such a nucleic acid, or a pharmaceutical composition comprising such an antibody or antigen binding fragment thereof, nucleic acid, vector, or cell, in the manufacture of a medicament for treatment of a cancer.

In another aspect, provided herein are methods of treating cancer in a subject in need thereof, such method comprising administering to the subject a therapeutically effective amount of an anti-human ENTPD2 antibody or antigen binding fragment described herein, in combination with a second therapeutic agent selected from a PD-1 inhibitor or a PD-L1 inhibitor.

In another aspect, provided herein are methods of stimulating an immune response in a subject, such method comprising administering to the subject a therapeutically effective amount of an anti-human ENTPD2 antibody or antigen binding fragment described herein, in combination with a second therapeutic agent selected from a PD-1 inhibitor or a PD-L1 inhibitor.

In another aspect, provided herein are compositions comprising an anti-human ENTPD2 antibody or antigen binding fragment described herein for use, in combination with a second therapeutic agent selected from a PD-1 inhibitor or a PD-L1 inhibitor, in the treatment of cancer in a subject.

In another aspect, provided herein are compositions comprising an anti-human ENTPD2 antibody or antigen binding fragment described herein, in combination with a second therapeutic agent selected from a PD-1 inhibitor or a PD-L1 inhibitor, for use in the treatment of cancer in a subject.

In some embodiments, the PD-1 inhibitor is a PD-1 antibody. In some embodiments, the PD-1 inhibitor is selected from PDR001, Nivolumab, Pembrolizumab, Pidilizumab, MEDI0680, REGN2810, TSR-042, PF-06801591, or AMP-224.

In some embodiments, the PD-L1 inhibitor is a PD-L1 antibody. In some embodiments, the PD-L1 inhibitor is selected from FAZ053, Atezolizumab, Avelumab, Durvalumab, or BMS-936559.

In some embodiments, the cancer is an ENTPD2+ cancer. In some embodiments, the cancer is colorectal cancer (CRC), gastric cancer (e.g., stomach adenocarcinoma, gastric carcinoma), esophageal cancer (e.g. esophageal squamous cell carcinoma (ESCC)), pancreatic cancer, cholangiocarcinoma, lung cancer (e.g., small cell lung cancer), breast cancer (e.g., breast adenocarcinoma), or ovarian cancer.

All publications, patents, and accession numbers mentioned herein are hereby incorporated by reference in their entirety as if each individual publication or patent was specifically and individually indicated to be incorporated by reference.

BRIEF DESCRIPTION OF THE DRAWINGS

FIG. 1B is table (Table 20) showing ENTPD2 receptor density across representative cancer cell lines.

FIG. 3A shows the amino acid sequence of anti-human ENTPD2 FAb22 heavy chain (SEQ ID NO: 330) and light chain (SEQ ID NO: 334) with the CDRs underlined (as defined by Kabat), and residues located at the antibody-antigen interface labeled for each Fab as (*). FIG. 3B shows the amino acid sequence of anti-human ENTPD2 FAb23 heavy chain (SEQ ID NO: 336) and light chains (SEQ ID NO: 239) with the CDRs underlined (as defined by Kabat), and residues located at the antibody-antigen interface labeled with (*). FIG. 3C shows the amino acid sequence of the anti-mouse ENTPD2 FAb24 heavy chain (SEQ ID NO: 338) and light chains (SEQ ID NO: 340) with the CDRs underlined (as defined by Kabat), and residues located at the antibody-antigen interface labeled with (*).

FIG. 4A shows the amino acid sequence of recombinant human ENTPD2 (residues 29-462, Y350A mutant) used in crystallographic studies (SEQ ID NO: 1014), with the secondary structure elements shown below the amino acid sequence. Bars represent α-helices and arrows represent β-strands. Unlabeled arrows and bars from sequence formatting breaks are contiguous to preceding structural elements labeled. Unstructured regions are unmarked. Soluble extracellular domain of human ENTPD2 spans residues 29-462. The construct utilizes an N-terminal GP67 secretion signal peptide (first 38 residues highlighted in gray) with the signal peptide cleavage site after last residue, and a C-terminal hexahistidine (SEQ ID NO: 1010) metal affinity tag to facilitate purification. Asn129, Asn294, Asn378 and Asn443 are predicted N-linked glycosylation sites for which glycosylation is observed in crystal structures and shown in italics. Asn64 is also a predicted N-linked glycosylation site not observed in these crystal structures. Residues located at the antigen-Fab interface for the FAb22 and FAb23 complexes are indicated by (*) and (:) symbols, respectively, below the amino acid sequence. FIG. 4B shows the amino acid sequence of recombinant murine ENTPD2 (residues 29-462) used in crystallography studies (SEQ ID NO: 1015), with the secondary structure elements shown below the amino acid sequence. The bars represent α-helices and arrows represent β-strands. Unlabeled arrows and bars from line breaks are contiguous to preceding structural elements labeled. Unstructured regions are unmarked. Mature murine ENTPD2 starts from Thr29. The construct utilizes an N-terminal GP67 secretion signal peptide (residues 1-38), with the signal peptide cleavage site after residue 38, and a C-terminal hexahistidine (SEQ ID NO: 1010) metal affinity tag to facilitate purification. Asn129, Asn294, Asn378 and Asn443 are potential N-linked glycosylation sites shown in italics. Residues positioned at the antigen-FAb24 interface are indicated by (#) symbol beneath the amino acid sequence.

DETAILED DESCRIPTION

Figure 1A:
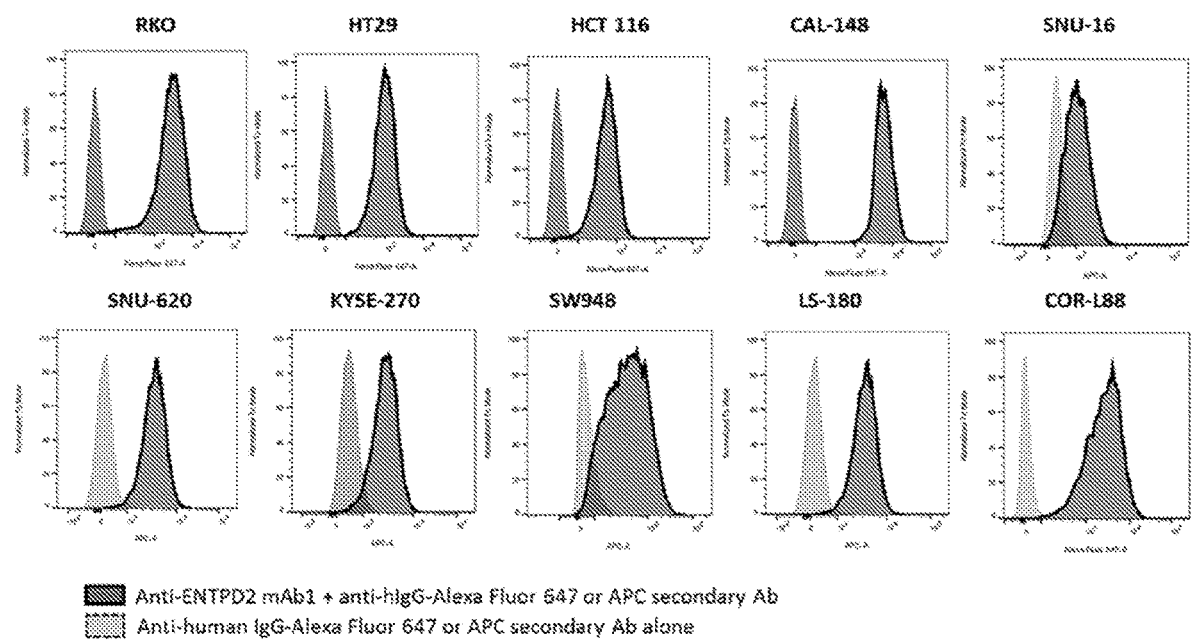
FIG. 1A depicts ENTPD2 expression across representative cancer cell lines as determined by flow cytometry.

Provided herein are antibodies or antigen binding fragments thereof, e.g., monoclonal antibodies or antigen binding fragments thereof, that specifically bind to the ectoenzyme ectonucleoside triphosphate diphosphohydrolase 2 (e.g., human ENTPD2 protein). The ENTPD2 antibodies or antigen binding fragments thereof are useful for treating ENTPD2-associated diseases, such as a cancer.

Definitions

As used in the specification and claims, the singular form "a", "an" and "the" include plural references unless the context clearly dictates otherwise. For example, the term "a cell" includes a plurality of cells, including mixtures thereof.

Throughout this specification and the claims which follow, unless the context requires otherwise, the word "comprise", and variations such as "comprises" and "comprising", are used herein in their open-ended and non-limiting sense unless otherwise noted.

When used herein "consisting of" excludes any element, step, or ingredient not specified in the aspect, embodiment and/or claim element. When used herein, "consisting essentially of" does not exclude materials or steps that do not materially affect the basic and novel characteristics of the aspect, embodiment and/or claim.

In each instance herein any of the terms "comprising", "consisting essentially of" and "consisting of" may be replaced with either of the other two terms.

All numerical designations, e.g., pH, temperature, time, concentration, and molecular weight, including ranges, are approximations which are varied (+) or (−) by increments of 0.1. It is to be understood, although not always explicitly stated that all numerical designations are preceded by the term "about". It also is to be understood, although not always explicitly stated, that the reagents described herein are merely examples and that equivalents of such are known in the art.

As used herein, ectonucleoside triphosphate diphosphohydrolase 2 (ENTPD2) (also known as CD39 Antigen-Like 1, CD39-like-1, CD39L1, Ecto-ATP Diphosphohydrolase 2, ecto-ATPase, Ecto-ATPase 2, Ecto-ATPDase 2, NTPDase-2, NTPDase 2) refers to the type 2 enzyme of the ecto-nucleoside triphosphate diphosphohydrolase family (E-NTPDase), which are a family of ecto-nucleosidases that hydrolyze 5'-triphosphates. The ENTPD2 enzyme is encoded by the gene ENTPD2. The human ENTPD2 gene is mapped to chromosomal location 9q34.3, and the genomic sequence of human ENTPD2 gene can be found in GenBank at NC_000009.12. The mRNA and protein sequences of the ENTPD2 human transcript variants can be found in GenBank with the following Accession Nos:

```
Isoform1: NM_203468.2 (mRNA) → NP_982293.1 (protein with 495 aa);

Isoform2: NM_001246.3 (mRNA) → NP_001237.1 (protein with 472 aa);

Ectonucleoside triphosphate diphosphohydrolase 2 isoform 1
[Homo sapiens, NP_982293.1]
```
(SEQ ID NO: 291)

```
MAGKVRSLLPPLLLAAAGLAGLLLLCVPTRDVREPPALKYGIVLDAGSSH

TSMFIYKWPADKENDTGIVGQHSSCDVPGGGISSYADNPSGASQSLVGCL

EQALQDVPKERHAGTPLYLGATAGMRLLNLTNPEASTSVLMAVTHTLTQY

PFDFRGARILSGQEEGVFGWVTANYLLENFIKYGWVGRWFRPRKGTLGAM

DLGGASTQITFETTSPAEDRASEVQLHLYGQHYRVYTHSFLCYGRDQVLQ

RLLASALQTHGFHPCWPRGFSTQVLLGDVYQSPCTMAQRPQNFNSSARVS

LSGSSDPHLCRDLVSGLFSFSSCPFSRCSFNGVFQPPVAGNFVAFSAFFY

TVDFLRTSMGLPVATLQQLEAAAVNVCNQTWAQLQARVPGQRARLADYCA

GAMFVQQLLSRGYGFDERAFGGVIFQKKAADTAVGWALGYMLNLTNLIPA

DPPGLRKGTDFSSWVVLLLLFASALLAALVLLLRQVHSAKLPSTI

Homo sapiens ectonucleoside triphosphate diphosphohydrolase 2
(ENTPD2), transcript variant 1, mRNA [NM_203468.2]
```
(SEQ ID NO: 292)

```
   1    ggctccccgc actctccggg tccacgcatc gtcctcccgc gcgcccgccc gcccatggcc 61    gggaaggtgc ggtcactgct gccgccgctg ctgctggccg ccgcgggcct cgccggcctc 121    ctactgctgt gcgtccccac ccgcgacgtc cgggagccgc ccgccctcaa gtatggcatc 181    gtcctggacg ctggttcttc acacacgtcc atgtttatct acaagtggcc ggcagacaag 241    gagaacgaca caggcattgt gggccagcac agctcctgtg atgttccagg tggggcatc 301    tccagctatg cagacaaccc ttctggggcc agccagagtc ttgttggatg cctcgaacag 361    gcgcttcagg atgtgcccaa agagagacac gcgggcacac ccctctacct gggagccaca 421    gcgggtatgc gcctgctcaa cctgaccaat ccagaggcct cgaccagtgt gctcatggca 481    gtgactcaca cactgaccca gtacccctt gacttccggg gtgcacgcat cctctcgggc 541    caggaagagg gggtgtttgg ctgggtgact gccaactacc tgctggagaa cttcatcaag 601    tacggctggg tgggccggtg gttccggcca cggaagggga cactgggggc catggacctg 661    ggggtgcct ctacccagat cactttgag acaaccagtc cagctgagga cagagccagc 721    gaggtccagc tgcatctcta cggccagcac taccgagtct acacccacag cttcctctgc 781    tatggcgtg accaggtcct ccagaggctg ctggccagcg ccctccgac ccacggcttc 841    cacccctgct ggccgagggg cttttccacc caagtgctgc tcggggatgt gtaccagtca 901    ccatgcacca tggcccagcg gccccagaac ttcaacagca gtgccagggt cagcctgtca 961    gggagcagtg accccacct ctgccgagat ctggtttctg ggctcttcag cttctcctcc 1021    tgcccccttct cccgatgctc tttcaatggg gtcttccagc ccccagtggc tgggaactt
```

```
1081   gtggccttct ctgccttctt ctacactgtg gacttttgc ggacttcgat ggggctgccc
1141   gtggccaccc tgcagcagct ggaggcagcc gcagtgaatg tctgcaacca gacctgggct
1201   cagctgcaag ctcgggtgcc agggcaacgg gcccgcctgg ccgactactg cgccggggcc
1261   atgttcgtgc agcagctgct gagtcgcggc tacggcttcg acgagcgcgc cttcggcggc
1321   gtgatcttcc agaagaaggc cgcggacact gcagtgggct gggcgctcgg ctacatgctg
1381   aacctgacca acctgatccc cgccgacccg ccggggctgc gcaagggcac agacttcagc
1441   tcctgggtcg tcctcctgct gctcttcgcc tccgcgctcc tggctgcgct tgtcctgctg
1501   ctgcgtcagg tgcactccgc caagctgcca agcaccattt aggggccgac ggggggcagct
1561   gccccatccc tccccaacc cctgtatccc caccccgtac tcccacccct cccacaaccc
1621   ctgtacctcc caccctgta tcccacccc tccacccacc cctctcccaa cctctctccc
1681   cgcccctgta tcctgcattc ctccacccac cctctatccc caccgctcc accccaccac
1741   tgtcttctcc atccttccac cccaccctca gcgtctctgc ccctaaggca gcccaggaaa
1801   taggaactga gactctggta cccacaggag cctgggtggg caaagagcgc tcaatccagc
1861   tccttgaacc cctccagccc gcttcagcct gggcatcact gcaggccccg tgctcctcct
1921   cctcctcctc agggctgggt ctccagagag tggggccttg gtcctgagaa tcagccctta
1981   gaggctcctt ctgtgtagtc tgggtctgta ctggggaggg tcacagccca cgggctggca
2041   gccagcccag cacctacttg taaaatttt gtaataaaaa gttttcccta gagacgtgaa
2101   aaaaaaaaaa aaaaaaaaaa aaaaaaaaaa aaaaaaaaaa aaaaaaaaaa aaaaaa
```

Ectonucleoside triphosphate diphosphohydrolase 2 isoform 2
[*Homo sapiens*, NP_001237.1]

(SEQ ID NO: 293)

MAGKVRSLLPPLLLAAAGLAGLLLLCVPTRDVREPPALKYGIVLDAGSSH

TSMFIYKWPADKENDTGIVGQHSSCDVPGGGISSYADNPSGASQSLVGCL

EQALQDVPKERHAGTPLYLGATAGMRLLNLTNPEASTSVLMAVTHTLTQY

PFDFRGARILSGQEEGVFGWVTANYLLENFIKYGWVGRWFRPRKGTLGAM

DLGGASTQITFETTSPAEDRASEVQLHLYGQHYRVYTHSFLCYGRDQVLQ

RLLASALQTHGFHPCWPRGFSTQVLLGDVYQSPCTMAQRPQNFNSSARVS

LSGSSDPHLCRDLVSGLFSFSSCPFSRCSFNGVFQPPVAGNFVAFSAFFY

TVDFLRTSMGLPVATLQQLEAAAVNVCNQTWAQQLLSRGYGFDERAFGGV

IFQKKAADTAVGWALGYMLNLTNLIPADPPGLRKGTDFSSWVVLLLLFAS

ALLAALVLLLRQVHSAKLPSTI

*Homo sapiens* ectonucleoside triphosphate diphosphohydrolase 2
(ENTPD2), transcript variant 2, mRNA [NM_001246.3]

(SEQ ID NO: 294)

```
  1   ggctccccgc actctccggg tccacgcatc gtcctcccgc gcgcccgccc gcccatggcc
 61   gggaaggtgc ggtcactgct gccgccgctg ctgctggccg ccgcgggcct cgccggcctc
121   ctactgctgt gcgtccccac ccgcgacgtc cgggagccgc ccgccctcaa gtatggcatc
181   gtcctggacg ctggttcttc acacacgtcc atgtttatct acaagtggcc ggcagacaag
241   gagaacgaca caggcattgt gggccagcac agctcctgtg atgttccagg tgggggcatc
301   tccagctatg cagacaaccc ttctggggcc agccagagtc ttgttggatg cctcgaacag
361   gcgcttcagg atgtgcccaa agagagacac gcgggcacac ccctctacct gggagccaca
421   gcgggtatgc gcctgctcaa cctgaccaat ccagaggcct cgaccagtgt gctcatggca
481   gtgactcaca cactgaccca gtacccccttt gacttccggg gtgcacgcat cctctcgggc
```

```
-continued
 541    caggaagagg gggtgtttgg ctgggtgact gccaactacc tgctggagaa cttcatcaag 601    tacggctggg tgggccggtg gttccggcca cggaagggga cactgggggc catggacctg 661    gggggtgcct ctacccagat cacttttgag acaaccagtc cagctgagga cagagccagc 721    gaggtccagc tgcatctcta cggccagcac taccgagtct acacccacag cttcctctgc 781    tatggccgtg accaggtcct ccagaggctg ctggccagcg ccctccagac ccacggcttc 841    caccoctgct ggccgagggg cttttccacc caagtgctgc tcggggatgt gtaccagtca 901    ccatgcacca tggcccagcg gcccagaac ttcaacagca gtgccagggt cagcctgtca 961    gggagcagtg accccacct ctgccgagat ctggtttctg ggctcttcag cttctcctcc 1021    tgcccttct cccgatgctc tttcaatggg gtcttccagc ccccagtggc tgggaactt 1081    gtggccttct ctgccttctt ctacactgtg gacttttgc ggacttcgat ggggctgccc 1141    gtggccaccc tgcagcagct ggaggcagcc gcagtgaatg tctgcaacca gacctgggct 1201    cagcagctgc tgagtcgcgg ctacggcttc gacgagcgcg ccttcggcgg cgtgatcttc 1261    cagaagaagg ccgcggacac tgcagtgggc tgggcgctcg gctacatgct gaacctgacc 1321    aacctgatcc ccgccgaccc gccgggggctg cgcaagggca cagacttcag ctcctgggtc 1381    gtcctcctgc tgctcttcgc ctccgcgctc ctggctgcgc ttgtcctgct gctgcgtcag 1441    gtgcactccg ccaagctgcc aagcaccatt taggggccga cggggggcagc tgccccatcc 1501    ctcccccaac ccctgtatcc ccaccccgta ctcccaccccc tcccacaacc cctgtacctc 1561    ccacccctgt atccccaccc ctccacccac ccctctccca acctctctcc ccgccctgt 1621    atcctgcatt cctccaccca ccctctatcc cccaccgctc cacccacca ctgtcttctc 1681    catccttcca ccccaccctc agcgtctctg ccctaaggc agcccaggaa ataggaactg 1741    agactctggt acccacagga gcctgggtgg gcaaagagcg ctcaatccag ctccttgaac 1801    ccctccagcc cgcttcagcc tgggcatcac tgcaggcccc gtgctcctcc tcctcctcct 1861    cagggctggg tctccagaga gtggggcctt ggtcctgaga atcagccctt agaggctcct 1921    tctgtgtagt ctgggtctgt actgggagg gtcacagccc acgggctggc agccagccca 1981    gcacctactt gtaaaaattt tgtaataaaa agttttcct agagacgtga aaaaaaaaaa 2041    aaaaaaaaa aaaaaaaaaa aaaaaaaaa aaaaaaaaaa aaaaaaa
```

As used herein, human ENTPD2 protein also encompasses proteins that have over its full length at least about 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity with any one of the ENTPD2 isoforms. The sequences of murine, Cynomolgus monkey, and other animal ENTPD2 proteins are known in the art.

The term "antibody", as used herein, refers to a protein, or polypeptide sequence derived from an immunoglobulin molecule that specifically binds to an antigen. Antibodies can be polyclonal or monoclonal, multiple or single chain, or intact immunoglobulins, and may be derived from natural sources or from recombinant sources. For example, a naturally occurring IgG antibody can be a glycoprotein comprising at least two heavy (H) chains and two light (L) chains inter-connected by disulfide bonds. Each heavy chain is comprised of a heavy chain variable region (abbreviated herein as VH) and a heavy chain constant region. The heavy chain constant region is comprised of three domains, CH1, CH2 and CH3. Each light chain is comprised of a light chain variable region (abbreviated herein as VL) and a light chain constant region. The light chain constant region is comprised of one domain, CL. The VH and VL regions can be further subdivided into regions of hypervariability, termed complementarity determining regions (CDR), interspersed with regions that are more conserved, termed framework regions (FR). Each VH and VL is composed of three CDRs and four FRs arranged from amino-terminus to carboxyl-terminus in the following order: FR1, CDR1, FR2, CDR2, FR3, CDR3, FR4. The variable regions of the heavy and light chains contain a binding domain that interacts with an antigen. The constant regions of the antibodies may mediate the binding of the immunoglobulin to host tissues or factors, including various cells of the immune system (e.g., effector cells) and the first component (C1q) of the classical complement system. An antibody can be a monoclonal antibody, human antibody, humanized antibody, camelised antibody, or chimeric antibody. The antibodies can be of any isotype (e.g., IgG, IgE, IgM, IgD, IgA and IgY), class (e.g., IgG1, IgG2, IgG3, IgG4, IgA1 and IgA2) or subclass.

The term "antibody fragment" or "antigen-binding fragment" refers to at least one portion of an antibody, that retains the ability to specifically interact with (e.g., by binding, steric hinderance, stabilizing/destabilizing, spatial distribution) an epitope of an antigen. Examples of antibody fragments include, but are not limited to, Fab, Fab', F(ab')2, Fv fragments, scFv antibody fragments, disulfide-linked Fvs (sdFv), a Fd fragment consisting of the VH and CH1 domains, linear antibodies, single domain antibodies such as sdAb (either VL or VH), camelid VHH domains, multispecific antibodies formed from antibody fragments such as a bivalent fragment comprising two Fab fragments linked by a disulfide bridge at the hinge region, and an isolated CDR or other epitope binding fragments of an antibody. An antigen binding fragment can also be incorporated into single domain antibodies, maxibodies, minibodies, nanobodies, intrabodies, diabodies, triabodies, tetrabodies, v-NAR and bis-scFv (see, e.g., Hollinger and Hudson, Nature Biotechnology 23:1126-1136, 2005). Antigen binding fragments can also be grafted into scaffolds based on polypeptides such as a fibronectin type III (Fn3) (see U.S. Pat. No. 6,703,199, which describes fibronectin polypeptide minibodies). The term "scFv" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the VL and VH variable regions in either order, e.g., with respect to the N-terminal and C-terminal ends of the polypeptide, the scFv may comprise VL-linker-VH or may comprise VH-linker-VL.

The terms "complementarity determining region" or "CDR", as used herein, refer to the sequences of amino acids within antibody variable regions which confer antigen specificity and binding affinity. For example, in general, there are three CDRs in each heavy chain variable region (e.g., HCDR1, HCDR2, and HCDR3) and three CDRs in each light chain variable region (e.g., LCDR1, LCDR2, and LCDR3). The precise amino acid sequence boundaries of a given CDR can be determined using any one of a number of well-known schemes, including those described by Kabat et al. (1991), "Sequences of Proteins of Immunological Interest," 5th Ed. Public Health Service, National Institutes of Health, Bethesda, MD ("Kabat" numbering scheme), Al-Lazikani et al., (1997) JMB 273, 927-948 ("Chothia" numbering scheme), or a combination thereof, and ImMunoGenTics (IMGT) numbering (Lefranc, M.-P., The Immunologist, 7, 132-136 (1999); Lefranc, M.-P. et al., Dev. Comp. Immunol., 27, 55-77 (2003) ("IMGT" numbering scheme). In a combined Kabat and Chothia numbering scheme for a given CDR region (for example, HC CDR1, HC CDR2, HC CDR3, LC CDR1, LC CDR2 or LC CDR3), in some embodiments, the CDRs correspond to the amino acid residues that are defined as part of the Kabat CDR, together with the amino acid residues that are defined as part of the Chothia CDR. As used herein, the CDRs defined according to the "Chothia" number scheme are also sometimes referred to as "hypervariable loops."

For example, under Kabat, the CDR amino acid residues in the heavy chain variable domain (VH) are numbered 31-35 (HCDR1) (e.g., insertion(s) after position 35), 50-65 (HCDR2), and 95-102 (HCDR3); and the CDR amino acid residues in the light chain variable domain (VL) are numbered 24-34 (LCDR1) (e.g., insertion(s) after position 27), 50-56 (LCDR2), and 89-97 (LCDR3). As another example, under Chothia, the CDR amino acids in the VH are numbered 26-32 (HCDR1) (e.g., insertion(s) after position 31), 52-56 (HCDR2), and 95-102 (HCDR3); and the amino acid residues in VL are numbered 26-32 (LCDR1) (e.g., insertion(s) after position 30), 50-52 (LCDR2), and 91-96 (LCDR3). By combining the CDR definitions of both Kabat and Chothia, the CDRs comprise or consist of, e.g., amino acid residues 26-35 (HCDR1), 50-65 (HCDR2), and 95-102 (HCDR3) in human VH and amino acid residues 24-34 (LCDR1), 50-56 (LCDR2), and 89-97 (LCDR3) in human VL. Under IMGT, the CDR amino acid residues in the VH are numbered approximately 26-35 (CDR1), 51-57 (CDR2) and 93-102 (CDR3), and the CDR amino acid residues in the VL are numbered approximately 27-32 (CDR1), 50-52 (CDR2), and 89-97 (CDR3) (numbering according to "Kabat"). Under IMGT, the CDR regions of an antibody can be determined using the program IMGT/DomainGap Align. Generally, unless specifically indicated, the antibody molecules can include any combination of one or more Kabat CDRs and/or Chothia CDRs.

The term "epitope" includes any protein determinant capable of specific binding to an immunoglobulin or otherwise interacting with a molecule. Epitopic determinants generally consist of chemically active surface groupings of molecules such as amino acids or carbohydrate or sugar side chains and can have specific three-dimensional structural characteristics, as well as specific charge characteristics. An epitope may be "linear" or "conformational." Conformational and linear epitopes are distinguished in that the binding to the former but not the latter is lost in the presence of denaturing solvents.

The term "monovalent antibody" as used herein, refers to an antibody that binds to a single epitope on a target molecule.

The term "bivalent antibody" as used herein, refers to an antibody that binds to two epitopes on at least two identical target molecules. The bivalent antibody may also crosslink the target molecules to one another. A "bivalent antibody" also refers to an antibody that binds to two different epitopes on at least two identical target molecules.

The term "multivalent antibody" refers to a single binding molecule with more than one valency, where "valency" is described as the number of antigen-binding moieties present per molecule of an antibody construct. As such, the single binding molecule can bind to more than one binding site on a target molecule. Examples of multivalent antibodies include, but are not limited to, bivalent antibodies, trivalent antibodies, tetravalent antibodies, pentavalent antibodies, and the like, as well as bispecific antibodies and biparatopic antibodies. For example, for ENTPD2, the multivalent antibody (e.g., a ENTPD2 biparatopic antibody) has a binding moiety for two domains of ENTPD2, respectively.

The term "multivalent antibody" also refers to a single binding molecule that has more than one antigen-binding moiety for two separate target molecules. For example, an antibody that binds to ENTPD2 (e.g., human ENTPD2 protein) and a second target molecule that is not ENTPD2. In one embodiment, a multivalent antibody is a tetravalent antibody that has four epitope binding domains. A tetravalent molecule may be bispecific and bivalent for each binding site on that target molecule.

The term "bispecific antibody" as used herein, refers to an antibody that binds to two or more different epitopes. In some embodiments, a bispecific antibody binds to two different targets. In some embodiments, a bispecific antibody binds to two different epitopes on a single target molecule. An antibody that binds to two different epitopes on a single target molecule is also known as a "biparatopic antibody."

The phrases "monoclonal antibody" or "monoclonal antibody composition" as used herein refers to polypeptides, including antibodies, bispecific antibodies, etc., that have substantially identical amino acid sequence or are derived from the same genetic source. This term also includes preparations of antibody molecules of single molecular composition. A monoclonal antibody composition displays a single binding specificity and affinity for a particular epitope.

The phrase "human antibody," as used herein, includes antibodies having variable regions in which both the framework and CDR regions are derived from sequences of human origin. Furthermore, if the antibody contains a constant region, the constant region is also derived from such human sequences, e.g., human germline sequences, or mutated versions of human germline sequences or antibody containing consensus framework sequences derived from human framework sequences analysis, for example, as described in Knappik, et al. (2000. J Mol Biol 296, 57-86). The structures and locations of immunoglobulin variable domains, e.g., CDRs, may be defined using well known numbering schemes, e.g., the Kabat numbering scheme, the Chothia numbering scheme, or a combination of Kabat and Chothia, and ImMunoGenTics (IMGT) numbering (see, e.g., Sequences of Proteins of Immunological Interest, U.S. Department of Health and Human Services (1991), eds. Kabat et al.; Al Lazikani et al., (1997) J. Mol. Bio. 273:927 948); Kabat et al., (1991) Sequences of Proteins of Immunological Interest, 5th edit., NIH Publication no. 91-3242 U.S. Department of Health and Human Services; Chothia et al., (1987) J. Mol. Biol. 196:901-917; Chothia et al., (1989) Nature 342:877-883; Al-Lazikani et al., (1997) J. Mal. Biol. 273:927-948 and Lefranc, M.-P., The Immunologist, 7, 132-136 (1999); Lefranc, M.-P. et al., Dev. Comp. Immunol., 27, 55-77 (2003)).

The human antibodies of the invention may include amino acid residues not encoded by human sequences (e.g., mutations introduced by random or site-specific mutagenesis in vitro or by somatic mutation in vivo, or a conservative substitution to promote stability or manufacturing). However, the term "human antibody" as used herein, is not intended to include antibodies in which CDR sequences derived from the germline of another mammalian species, such as a mouse, have been grafted onto human framework sequences.

The phrase "recombinant human antibody" as used herein, includes all human antibodies that are prepared, expressed, created or isolated by recombinant means, such as antibodies isolated from an animal (e.g., a mouse) that is transgenic or transchromosomal for human immunoglobulin genes or a hybridoma prepared therefrom, antibodies isolated from a host cell transformed to express the human antibody, e.g., from a transfectoma, antibodies isolated from a recombinant, combinatorial human antibody library, and antibodies prepared, expressed, created or isolated by any other means that involve splicing of all or a portion of a human immunoglobulin gene, sequences to other DNA sequences. Such recombinant human antibodies have variable regions in which the framework and CDR regions are derived from human germline immunoglobulin sequences. In certain embodiments, however, such recombinant human antibodies can be subjected to in vitro mutagenesis (or, when an animal transgenic for human Ig sequences is used, in vivo somatic mutagenesis) and thus the amino acid sequences of the VH and VL regions of the recombinant antibodies are sequences that, while derived from and related to human germline VH and VL sequences, may not naturally exist within the human antibody germline repertoire in vivo.

The term "Fc region" as used herein refers to a polypeptide comprising the CH3, CH2 and at least a portion of the hinge region of a constant domain of an antibody. Optionally, an Fc region may include a CH4 domain, present in some antibody classes. An Fc region, may comprise the entire hinge region of a constant domain of an antibody. In one embodiment, the invention comprises an Fc region and a CH1 region of an antibody. In one embodiment, the invention comprises an Fc region CH3 region of an antibody. In another embodiment, the invention comprises an Fc region, a CH1 region and a Ckappa/lambda region from the constant domain of an antibody. In one embodiment, a binding molecule of the invention comprises a constant region, e.g., a heavy chain constant region. In one embodiment, such a constant region is modified compared to a wild-type constant region. That is, the polypeptides of the invention disclosed herein may comprise alterations or modifications to one or more of the three heavy chain constant domains (CH1, CH2 or CH3) and/or to the light chain constant region domain (CL). Example modifications include additions, deletions or substitutions of one or more amino acids in one or more domains. Such changes may be included to optimize effector function, half-life, etc.

As used herein, the term "affinity" refers to the strength of interaction between antibody and antigen at single antigenic sites. Within each antigenic site, the variable region of the antibody "arm" interacts through weak non-covalent forces with the antigen at numerous sites; the more interactions, the stronger the affinity. As used herein, the term "high affinity" for an IgG antibody or fragment thereof (e.g., a Fab fragment) refers to an antibody having a knock down of $10^{-8}$ M or less, $10^{-9}$ M or less, or $10^{-10}$ M, or $10^{-11}$ M or less, or $10^{-12}$ M or less, or $10^{-13}$ M or less for a target antigen. However, high affinity binding can vary for other antibody isotypes. For example, high affinity binding for an IgM isotype refers to an antibody having a knock down of $10^{-7}$ M or less, or $10^{-8}$ M or less.

As used herein, the term "avidity" refers to an informative measure of the overall stability or strength of the antibody-antigen complex. It is controlled by three major factors: antibody epitope affinity; the valency of both the antigen and antibody; and the structural arrangement of the interacting parts. Ultimately these factors define the specificity of the antibody, that is, the likelihood that the particular antibody is binding to a precise antigen epitope.

The term "binding specificity" as used herein refers to the ability of an individual antibody combining site to react with one antigenic determinant and not with a different antigenic determinant. The combining site of the antibody is located in the Fab portion of the molecule and is constructed from the hypervariable regions of the heavy and light chains. Binding affinity of an antibody is the strength of the reaction between a single antigenic determinant and a single combining site on the antibody. It is the sum of the attractive and repulsive forces operating between the antigenic determinant and the combining site of the antibody.

The term "treat" and "treatment" refer to both therapeutic treatment and prophylactic or preventive measures, wherein the object is to prevent or slow down an undesired physiological change or disorder. For purpose of this invention, beneficial or desired clinical results include, but are not limited to, alleviation of symptoms, diminishment of extent of disease, stabilized (i.e., not worsening) state of disease, delay or slowing of disease progression, amelioration or palliation of the disease state, and remission (whether partial or total), whether detectable or undetectable. "Treatment" can also mean prolonging survival as compared to expected survival if not receiving treatment. In other embodiments the terms "treat", "treatment" and "treating" refer to the inhibition of the progression of a proliferative disorder, either physically by, e.g., stabilization of a discernible symptom, physiologically by, e.g., stabilization of a physical parameter, or both. In other embodiments the terms "treat", "treatment" and "treating" refer to the reduction or stabilization of tumor size or cancerous cell count.

The term "subject" refers to an animal, human or non-human, to whom treatment according to the methods of the present invention is provided. Veterinary and non-veterinary applications are contemplated. The term includes, but is not limited to, mammals, e.g., humans, other primates, pigs, rodents such as mice and rats, rabbits, guinea pigs, hamsters, cows, horses, cats, dogs, sheep and goats. Typical subjects include humans, farm animals, and domestic pets such as cats and dogs. In some embodiments, the subject is a human.

An "effective amount" refers to an amount sufficient to effect beneficial or desired results. For example, a therapeutic amount is one that achieves the desired therapeutic effect. This amount can be the same or different from a prophylactically effective amount, which is an amount necessary to prevent onset of disease or disease symptoms. An effective amount can be administered in one or more administrations, applications or dosages. A "therapeutically effective amount" of a therapeutic compound (i.e., an effective dosage) depends on the therapeutic compounds selected. The compositions can be administered from one or more times per day to one or more times per week. The skilled artisan will appreciate that certain factors may influence the dosage and timing required to effectively treat a subject, including but not limited to the severity of the disease or disorder, previous treatments, the general health and/or age of the subject, and other diseases present. Moreover, treatment of a subject with a therapeutically effective amount of the therapeutic compounds described herein can include a single treatment or a series of treatments.

The term "nucleic acid" or "polynucleotide" refers to deoxyribonucleic acids (DNA) or ribonucleic acids (RNA) and polymers thereof in either single- or double-stranded form. The term "set of nucleic acids" may, for example, include separate isolated nucleic acids encoding a light chain and a heavy chain of an antibody or domains of a bi-specific or multispecific antibody. Unless specifically limited, the term encompasses nucleic acids containing known analogues of natural nucleotides that have similar binding properties as the reference nucleic acid and are metabolized in a manner similar to naturally occurring nucleotides. Unless otherwise indicated, a particular nucleic acid sequence also implicitly encompasses conservatively modified variants thereof (e.g., degenerate codon substitutions), alleles, orthologs, SNPs, and complementary sequences as well as the sequence explicitly indicated. Specifically, degenerate codon substitutions may be achieved by generating sequences in which the third position of one or more selected (or all) codons is substituted with mixed-base and/or deoxyinosine residues (Batzer et al., Nucleic Acid Res. 19:5081 (1991); Ohtsuka et al., J. Biol. Chem. 260: 2605-2608 (1985); and Rossolini et al., Mol. Cell. Probes 8:91-98 (1994)).

The terms "peptide", "polypeptide", and "protein" are used interchangeably, and refer to a compound comprised of amino acid residues covalently linked by peptide bonds. A protein or peptide must contain at least two amino acids, and no limitation is placed on the maximum number of amino acids that can comprise a protein's or peptide's sequence. Polypeptides include any peptide or protein comprising two or more amino acids joined to each other by peptide bonds. As used herein, the term refers to both short chains, which also commonly are referred to in the art as peptides, oligopeptides and oligomers, for example, and to longer chains, which generally are referred to in the art as proteins, of which there are many types. "Polypeptides" include, for example, biologically active fragments, substantially homologous polypeptides, oligopeptides, homodimers, heterodimers, variants of polypeptides, modified polypeptides, derivatives, analogs, fusion proteins, among others. A polypeptide includes a natural peptide, a recombinant peptide, or a combination thereof.

The term "conservative sequence modifications" refers to amino acid modifications that do not significantly affect or alter the binding characteristics of the antibody or antibody fragment containing the amino acid sequence. Such conservative modifications include amino acid substitutions, additions and deletions. Modifications can be introduced into an antibody or antibody fragment of the invention by standard techniques known in the art, such as site-directed mutagenesis and PCR-mediated mutagenesis. Conservative amino acid substitutions are ones in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine, tryptophan), nonpolar side chains (e.g., alanine, valine, leucine, isoleucine, proline, phenylalanine, methionine), beta-branched side chains (e.g., threonine, valine, isoleucine) and aromatic side chains (e.g., tyrosine, phenylalanine, tryptophan, histidine).

The term "homologous" or "identity" refers to the subunit sequence identity between two polymeric molecules, e.g., between two nucleic acid molecules, such as, two DNA molecules or two RNA molecules, or between two polypeptide molecules. When a subunit position in both of the two molecules is occupied by the same monomeric subunit; e.g., if a position in each of two DNA molecules is occupied by adenine, then they are homologous or identical at that position. The homology between two sequences is a direct function of the number of matching or homologous positions; e.g., if half (e.g., five positions in a polymer ten subunits in length) of the positions in two sequences are homologous, the two sequences are 50% homologous; if 90% of the positions (e.g., 9 of 10), are matched or homologous, the two sequences are 90% homologous. Percentage of "sequence identity" can be determined by comparing two optimally aligned sequences over a comparison window, where the fragment of the amino acid sequence in the comparison window may comprise additions or deletions (e.g., gaps or overhangs) as compared to the reference sequence (which does not comprise additions or deletions) for optimal alignment of the two sequences. The percentage can be calculated by determining the number of positions at which the identical amino acid residue occurs in both sequences to yield the number of matched positions, dividing the number of matched positions by the total number of positions in the window of comparison, and multiplying the result by 100 to yield the percentage of sequence identity. The output is the percent identity of the subject sequence with respect to the query sequence.

The term "isolated" means altered or removed from the natural state. For example, a nucleic acid or a peptide naturally present in a living animal is not "isolated," but the same nucleic acid or peptide partially or completely separated from the coexisting materials of its natural state is "isolated." An isolated nucleic acid or protein can exist in substantially purified form, or can exist in a non-native environment such as, for example, a host cell. An isolated antibody is substantially free of other antibodies having different antigenic specificities (e.g., an isolated antibody that specifically binds ENTPD2 is substantially free of antibodies that specifically bind antigens other than ENTPD2). An isolated antibody that specifically binds a target molecule may, however, have cross-reactivity to the same antigens from other species, e.g., an isolated antibody that specifically binds ENTPD2 may bind ENTPD2 molecules from other species. Moreover, an isolated antibody may be substantially free of other cellular material and/or chemicals.

Unless otherwise defined, all technical and scientific terms used herein have the same meaning as commonly understood by one of ordinary skill in the art to which this invention pertains. Although methods and materials similar or equivalent to those described herein can be used to practice the invention, suitable methods and materials are described below. All publications, patent applications, patents, and other references mentioned herein are incorporated by reference in their entirety. In case of conflict, the present specification, including definitions, will control. In addition, the materials, methods, and examples are illustrative only and not intended to be limiting.

The details of one or more embodiments of the invention are set forth in the accompanying drawings and the description below. Other features, objects, and advantages of the invention will be apparent from the description and drawings, and from the claims.

Antibodies and Antigen-Binding Fragments Thereof that Specifically Bind to Human ENTPD2

In one aspect, provided herein are antibodies or antigen binding fragments thereof, e.g., monoclonal antibodies or antigen binding fragments thereof, that specifically bind to ENTPD2 protein ("ENTPD2 antibodies or antigen binding fragments" or "anti-ENTPD2 antibodies or antigen binding fragments"). In some embodiments, provided herein are antibodies or antigen binding fragments thereof, e.g., monoclonal antibodies or antigen binding fragments thereof, that specifically bind to human ENTPD2 protein ("human ENTPD2 antibodies or antigen binding fragments" or "anti-human ENTPD2 antibodies or antigen binding fragments").

In some embodiments, the anti-ENTPD2 antibodies or antigen-binding fragments thereof (e.g., anti-human ENTPD2 antibodies or antigen binding fragments) provided herein include a heavy chain CDR1 (HCDR1), a heavy chain CDR2 (HCDR2), a heavy chain CDR3 (HCDR3), and a light chain CDR1 (LCDR1), a light chain CDR2 (LCDR2), and a light chain CDR3 (LCDR3). In some embodiments, the anti-ENTPD2 antibodies or antigen binding fragments (e.g., anti-human ENTPD2 antibodies or antigen binding fragments) provided herein include a heavy chain variable region (VH) comprising CDR1, CDR2, and CDR3 and a light chain variable region (VL) comprising CDR1, CDR2, and CDR3. In some embodiments, the anti-ENTPD2 antibodies or antigen-binding fragments (e.g., anti-human ENTPD2 antibodies or antigen binding fragments) provided herein include a full length heavy chain sequence (HC) and a full length light chain sequence (LC).

Table 1 lists the sequences of exemplary the ENTPD2 antibodies or antigen-binding fragments that specifically bind to human ENTPD2 protein.

TABLE 1

Sequences of Exemplary Monoclonal Antibodies (MABs) and Antibody Fragments (FABs) That Bind Human ENTPD2

| ANTI-HUMAN ENTPD2 MAB1 | | | |
|---|---|---|---|
| SEQ ID NO: 1 | HCDR1 | (KABAT) | DYNMD |
| SEQ ID NO: 2 | HCDR2 | (KABAT) | DINPKYDISTYNQQFKG |
| SEQ ID NO: 3 | HCDR3 | (KABAT) | RGFFLYYGINYYYFDV |
| SEQ ID NO: 4 | HCDR1 | (CHOTHIA) | GYTFTDY |
| SEQ ID NO: 5 | HCDR2 | (CHOTHIA) | NPKYDI |
| SEQ ID NO: 3 | HCDR3 | (CHOTHIA) | RGFFLYYGINYYYFDV |
| SEQ ID NO: 6 | HCDR1 (COMBINED) | | GYTFTDYNMD |
| SEQ ID NO: 2 | HCDR2 (COMBINED) | | DINPKYDISTYNQQFKG |
| SEQ ID NO: 3 | HCDR3 (COMBINED) | | RGFFLYYGINYYYFDV |
| SEQ ID NO: 7 | HCDR1 | (IMGT) | GYTFTDYN |
| SEQ ID NO: 8 | HCDR2 | (IMGT) | INPKYDIS |
| SEQ ID NO: 9 | HCDR3 | (IMGT) | ARRGFFLYYGINYYYFDV |
| SEQ ID NO: 10 | VH | | EVQLVQSGAEVKKPGESLKISCKASGYTFTDYNMD WVRQMPGKGLEWMGDINPKYDISTYNQQFKGQVTI |

TABLE 1-continued

Sequences of Exemplary Monoclonal Antibodies (MAbs) and
Antibody Fragments (FABs) That Bind Human ENTPD2

| | | |
|---|---|---|
| | | SADKSIRTAYLQWSSLKASDTAMYYCARRGFFLYYG<br>INYYYFDVWGQGTLVTVSS |
| SEQ ID NO: 11 | VH DNA | GAAGTGCAGCTGGTGCAGTCTGGCGCCGAAGTGA<br>AGAAGCCTGGCGAGTCCCTGAAGATCTCCTGCAAG<br>GCCTCCGGCTACACCTTCACCGACTACAACATGGA<br>CTGGGTGCGACAGATGCCCGGCAAGGGCCTGGAA<br>TGGATGGGCGACATCAACCCTAAGTACGACATCTC<br>CACCTACAACCAGCAGTTCAAGGGCCAAGTGACC<br>ATCTCCGCCGACAAGTCCATCCGGACCGCCTACCT<br>GCAGTGGTCCTCCCTGAAGGCCTCTGACACCGCCA<br>TGTACTACTGCGCCAGACGGGGCTTCTTCCTGTAC<br>TACGGCATCAACTACTACTACTTCGACGTGTGGGG<br>CCAGGGCACCCTCGTGACAGTGTCATCT |
| SEQ ID NO: 12 | HC | EVQLVQSGAEVKKPGESLKISCKASGYTFTDYNMD<br>WVRQMPGKGLEWMGDINPKYDISTYNQQFKGQVTI<br>SADKSIRTAYLQWSSLKASDTAMYYCARRGFFLYYG<br>INYYYFDVWGQGTLVTVSSASTKGPSVFPLAPSSKST<br>SGGTAALGCLVKDYFPEPVTVSWNSGALTSGVHTFP<br>AVLQSSGLYSLSSVVTVPSSSLGTQTYICNVNHKPSN<br>TKVDKRVEPKSCDKTHTCPPCPAPELLGGPSVFLFPP<br>KPKDTLMISRTPEVTCVVVDVSHEDPEVKFNWYVDG<br>VEVHNAKTKPREEQYNSTYRVVSVLTVLHQDWLNG<br>KEYKCKVSNKALPAPIEKTISKAKGQPREPQVYTLPP<br>SREEMTKNQVSLTCLVKGFYPSDIAVEWESNGQPEN<br>NYKTTPPVLDSDGSFFLYSKLTVDKSRWQQGNVFSC<br>SVMHEALHNHYTQKSLSLSPGK |
| SEQ ID NO: 13 | HC DNA | GAAGTGCAGCTGGTGCAGTCTGGCGCCGAAGTGA<br>AGAAGCCTGGCGAGTCCCTGAAGATCTCCTGCAAG<br>GCCTCCGGCTACACCTTCACCGACTACAACATGGA<br>CTGGGTGCGACAGATGCCCGGCAAGGGCCTGGAA<br>TGGATGGGCGACATCAACCCTAAGTACGACATCTC<br>CACCTACAACCAGCAGTTCAAGGGCCAAGTGACC<br>ATCTCCGCCGACAAGTCCATCCGGACCGCCTACCT<br>GCAGTGGTCCTCCCTGAAGGCCTCTGACACCGCCA<br>TGTACTACTGCGCCAGACGGGGCTTCTTCCTGTAC<br>TACGGCATCAACTACTACTACTTCGACGTGTGGGG<br>CCAGGGCACCCTCGTGACAGTGTCATCTGCTAGCA<br>CCAAGGGCCCAAGTGTGTTTCCCCTGGCCCCCAGC<br>AGCAAGTCTACTTCCGGCGGAACTGCTGCCCTGGG<br>TTGCCTGGTGAAGGACTACTTCCCCGAGCCCGTGA<br>CAGTGTCCTGGAACTCTGGGGCTCTGACTTCCGGC<br>GTGCACACCTTCCCCGCCGTGCTGCAGAGCAGCGG<br>CCTGTACAGCCTGAGCAGCGTGGTGACAGTGCCCT<br>CCAGCTCTCTGGGAACCCAGACCTATATCTGCAAC<br>GTGAACCACAAGCCCAGCAACACCAAGGTGGACA<br>AGAGAGTGGAGCCCAAGAGCTGCGACAAGACCCA<br>CACCTGCCCCCCCTGCCCAGCTCCAGAACTGCTGG<br>GAGGGCCTTCCGTGTTCCTGTTCCCCCCCAAGCCC<br>AAGGACACCCTGATGATCAGCAGGACCCCCGAGG<br>TGACCTGCGTGGTGGTGGACGTGTCCCACGAGGAC<br>CCAGAGGTGAAGTTCAACTGGTACGTGGACGGCGT<br>GGAGGTGCACAACGCCAAGACCAAGCCCAGAGAG<br>GAGCAGTACAACAGCACCTACAGGGTGGTGTCCGT<br>GCTGACCGTGCTGCACCAGGACTGGCTGAACGGCA<br>AAGAATACAAGTGCAAAGTCTCCAACAAGGCCCT<br>GCCAGCCCCAATCGAAAAGACAATCAGCAAGGCC<br>AAGGGCCAGCCACGGGAGCCCCAGGTGTACACCC<br>TGCCCCCCAGCCGGGAGGAGATGACCAAGAACCA<br>GGTGTCCCTGACCTGTCTGGTGAAGGGCTTCTACC<br>CCAGCGATATCGCCGTGGAGTGGGAGAGCAACGG<br>CCAGCCCGAGAACAACTACAAGACCACCCCCCCA<br>GTGCTGGACAGCGACGGCAGCTTCTTCCTGTACAG<br>CAAGCTGACCGTGGACAAGTCCAGGTGGCAGCAG<br>GGCAACGTGTTCAGCTGCAGCGTGATGCACGAGGC<br>CCTGCACAACCACTACACCCAGAAGTCCCTGAGCC<br>TGAGCCCCGGCAAG |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |

TABLE 1-continued

Sequences of Exemplary Monoclonal Antibodies (MAbs) and
Antibody Fragments (FABs) That Bind Human ENTPD2

| SEQ ID NO: 18 | LCDR2 (CHOTHIA) | STS |
| --- | --- | --- |
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 21 | VL | DIQLTQSPSSLSASVGDRVTITCSASSSVSYIHWFQQK PGKAPKLLIYSTSNLASGVPSRFSGSGSGTFFTLTISSL QPEDFATYFCHQWSSYPWTFGQGTKVEIK |
| SEQ ID NO: 22 | VL DNA | GATATCCAGCTGACCCAGTCCCCTTCCAGCCTGTC TGCCTCTGTGGGCGACAGAGTGACAATTACCTGCT CCGCCTCCTCCTCCGTGTCCTACATCCACTGGTTCC AGCAGAAGCCCGGCAAGGCCCCCAAGCTGCTGAT CTACTCCACCTCCAACCTGGCCTCCGGCGTGCCCT CTAGATTCTCCGGCTCTGGCTCTGGCACCTTTTTTA CCCTGACCATCTCCAGCCTGCAGCCCGAGGACTTC GCCACCTACTTTTGCCACCAGTGGTCCAGCTACCC CTGGACCTTTGGCCAGGGCACCAAGGTGGAAATCA AG |
| SEQ ID NO: 23 | LC | DIQLTQSPSSLSASVGDRVTITCSASSSVSYIHWFQQK PGKAPKLLIYSTSNLASGVPSRFSGSGSGTFFTLTISSL QPEDFATYFCHQWSSYPWTFGQGTKVEIKRTVAAPS VFIFPPSDEQLKSGTASVVCLLNNFYPREAKVQWKV DNALQSGNSQESVTEQDSKDSTYSLSSTLTLSKADYE KHKVYACEVTHQGLSSPVTKSFNRGEC |
| SEQ ID NO: 24 | LC DNA | GATATCCAGCTGACCCAGTCCCCTTCCAGCCTGTC TGCCTCTGTGGGCGACAGAGTGACAATTACCTGCT CCGCCTCCTCCTCCGTGTCCTACATCCACTGGTTCC AGCAGAAGCCCGGCAAGGCCCCCAAGCTGCTGAT CTACTCCACCTCCAACCTGGCCTCCGGCGTGCCCT CTAGATTCTCCGGCTCTGGCTCTGGCACCTTTTTTA CCCTGACCATCTCCAGCCTGCAGCCCGAGGACTTC GCCACCTACTTTTGCCACCAGTGGTCCAGCTACCC CTGGACCTTTGGCCAGGGCACCAAGGTGGAAATCA AGCGTACGGTGGCCGCTCCCAGCGTGTTCATCTTC CCCCCCAGCGACGAGCAGCTGAAGAGTGGCACCG CCAGCGTGGTGTGCCTGCTGAACAACTTCTACCCC CGGGAGGCCAAGGTGCAGTGGAAGGTGGACAACG CCCTGCAGAGCGGCAACAGCCAGGAGAGCGTCAC CGAGCAGGACAGCAAGGACTCCACCTACAGCCTG AGCAGCACCCTGACCCTGAGCAAGGCCGACTACG AGAAGCATAAGGTGTACGCCTGCGAGGTGACCCA CCAGGGCCTGTCCAGCCCCGTGACCAAGAGCTTCA ACAGGGGCGAGTGC |

| ANTI-HUMAN ENTPD2 MAB2 | | |
| --- | --- | --- |
| SEQ ID NO: 1 | HCDR1 (KABAT) | DYNMD |
| SEQ ID NO: 2 | HCDR2 (KABAT) | DINPKYDISTYNQQFKG |
| SEQ ID NO: 3 | HCDR3 (KABAT) | RGFFLYYGINYYYFDV |
| SEQ ID NO: 4 | HCDR1 (CHOTHIA) | GYTFTDY |
| SEQ ID NO: 5 | HCDR2 (CHOTHIA) | NPKYDI |
| SEQ ID NO: 3 | HCDR3 (CHOTHIA) | RGFFLYYGINYYYFDV |

TABLE 1-continued

Sequences of Exemplary Monoclonal Antibodies (MABs) and
Antibody Fragments (FABs) That Bind Human ENTPD2

| SEQ ID NO: 6 | HCDR1 (COMBINED) | GYTFTDYNMD |
|---|---|---|
| SEQ ID NO: 2 | HCDR2 (COMBINED) | DINPKYDISTYNQQFKG |
| SEQ ID NO: 3 | HCDR3 (COMBINED) | RGFFLYYGINYYYFDV |
| SEQ ID NO: 7 | HCDR1 (IMGT) | GYTFTDYN |
| SEQ ID NO: 8 | HCDR2 (IMGT) | INPKYDIS |
| SEQ ID NO: 9 | HCDR3 (IMGT) | ARRGFFLYYGINYYYFDV |
| SEQ ID NO: 25 | VH | QVQLVQSGAEVVKPGASVKISCKASGYTFTDYNMD WVKQAPGQRLEWIGDINPKYDISTYNQQFKGKATIT VDKSASTAYMELSSLRSEDTAVYYCARRGFFLYYGI NYYYFDVWGQGTLVTVSS |
| SEQ ID NO: 26 | VH DNA | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACAAGTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCC |
| SEQ ID NO: 27 | HC | QVQLVQSGAEVVKPGASVKISCKASGYTFTDYNMD WVKQAPGQRLEWIGDINPKYDISTYNQQFKGKATIT VDKSASTAYMELSSLRSEDTAVYYCARRGFFLYYGI NYYYFDVWGQGTLVTVSSASTKGPSVFPLAPSSKSTS GGTAALGCLVKDYFPEPVTVSWNSGALTSGVHTFPA VLQSSGLYSLSSVVTVPSSSLGTQTYICNVNHKPSNT KVDKRVEPKSCDKTHTCPPCPAPELLGGPSVFLFPPK PKDTLMISRTPEVTCVVVDVSHEDPEVKFNWYVDGV EVHNAKTKPREEQYNSTYRVVSVLTVLHQDWLNGK EYKCKVSNKALPAPIEKTISKAKGQPREPQVYTLPPS REEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| SEQ ID NO: 28 | HC DNA | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACAAGTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCCGCTAGCAC CAAGGGCCCAAGTGTGTTTCCCCTGGCCCCCAGCA GCAAGTCTACTTCCGGCGGAACTGCTGCCCTGGGT TGCCTGGTGAAGGACTACTTCCCCGAGCCCGTGAC AGTGTCCTGGAACTCTGGGGCTCTGACTTCCGGCG TGCACACCTTCCCCGCCGTGCTGCAGAGCAGCGGC CTGTACAGCCTGAGCAGCGTGGTGACAGTGCCCTC CAGCTCTCTGGGAACCCAGACCTATATCTGCAACG TGAACCACAAGCCCAGCAACACCAAGGTGGACAA GAGAGTGGAGCCCAAGAGCTGCGACAAGACCCAC ACCTGCCCCCCTGCCCAGCTCCAGAACTGCTGGG AGGGCCTTCCGTGTTCCTGTTCCCCCCCAAGCCCA AGGACACCCTGATGATCAGCAGGACCCCCGAGGT GACCTGCGTGGTGGTGGACGTGTCCCACGAGGACC CAGAGGTGAAGTTCAACTGGTACGTGGACGGCGT GGAGGTGCACAACGCCAAGACCAAGCCCAGAGAG GAGCAGTACAACAGCACCTACAGGGTGGTGTCCGT GCTGACCGTGCTGCACCAGGACTGGCTGAACGGCA AGGAATACAAGTGCAAAGTCTCCAACAAGGCCCT GCCAGCCCCAATCGAAAAGACAATCAGCAAGGCC AAGGGCCAGCCACGGGAGCCCCAGGTGTACACCC |

TABLE 1-continued

Sequences of Exemplary Monoclonal Antibodies (MABs) and
Antibody Fragments (FABs) That Bind Human ENTPD2

|  |  |  |
|---|---|---|
|  |  | TGCCCCCCAGCCGGGAGGAGATGACCAAGAACCA<br>GGTGTCCCTGACCTGTCTGGTGAAGGGCTTCTACC<br>CCAGCGATATCGCCGTGGAGTGGGAGAGCAACGG<br>CCAGCCCGAGAACAACTACAAGACCACCCCCCA<br>GTGCTGGACAGCGACGGCAGCTTCTTCCTGTACAG<br>CAAGCTGACCGTGGACAAGTCCAGGTGGCAGCAG<br>GGCAACGTGTTCAGCTGCAGCGTGATGCACGAGGC<br>CCTGCACAACCACTACACCCAGAAGTCCCTGAGCC<br>TGAGCCCCGGCAAG |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 18 | LCDR2 (CHOTHIA) | STS |
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 29 | VL | EIVLTQSPATLSASPGERITLSCSASSSVSYIHWYQQK<br>PGQAPRLLIYSTSNLASGIPARFSGSGSGTFYTLTISSV<br>EPEDAAVYYCHQWSSYPWTFGGGTKLEIK |
| SEQ ID NO: 30 | VL DNA | GAGATCGTGCTGACCCAGTCCCCTGCCACCCTGTC<br>TGCCAGCCCTGGCGAGCGGATCACCCTGTCCTGCT<br>CCGCCTCCTCCTCCGTGTCCTACATCCACTGGTATC<br>AGCAGAAGCCCGGCCAGGCCCCTCGGCTGCTGATC<br>TACTCCACCTCCAACCTGGCCTCCGGCATCCCTGC<br>CAGATTCTCCGGCTCTGGCTCCGGCACCTTTTACAC<br>CCTGACCATCTCCAGCGTGGAACCCGAGGACGCCG<br>CCGTGTACTACTGCCACCAGTGGTCCAGCTACCCC<br>TGGACCTTCGGCGGAGGCACCAAGCTGGAAATCA<br>AG |
| SEQ ID NO: 31 | LC | EIVLTQSPATLSASPGERITLSCSASSSVSYIHWYQQK<br>PGQAPRLLIYSTSNLASGIPARFSGSGSGTFYTLTISSV<br>EPEDAAVYYCHQWSSYPWTFGGGTKLEIKRTVAAPS<br>VFIFPPSDEQLKSGTASVVCLLNNFYPREAKVQWKV<br>DNALQSGNSQESVTEQDSKDSTYSLSSTLTLSKADYE<br>KHKVYACEVTHQGLSSPVTKSFNRGEC |
| SEQ ID NO: 32 | LC DNA | GAGATCGTGCTGACCCAGTCCCCTGCCACCCTGTC<br>TGCCAGCCCTGGCGAGCGGATCACCCTGTCCTGCT<br>CCGCCTCCTCCTCCGTGTCCTACATCCACTGGTATC<br>AGCAGAAGCCCGGCCAGGCCCCTCGGCTGCTGATC<br>TACTCCACCTCCAACCTGGCCTCCGGCATCCCTGC<br>CAGATTCTCCGGCTCTGGCTCCGGCACCTTTTACAC<br>CCTGACCATCTCCAGCGTGGAACCCGAGGACGCCG<br>CCGTGTACTACTGCCACCAGTGGTCCAGCTACCCC<br>TGGACCTTCGGCGGAGGCACCAAGCTGGAAATCA<br>AGCGTACGGTGGCCGCTCCCAGCGTGTTCATCTTC<br>CCCCCCAGCGACGAGCAGCTGAAGAGTGGCACCG<br>CCAGCGTGGTGTGCCTGCTGAACAACTTCTACCCC<br>CGGGAGGCCAAGGTGCAGTGGAAGGTGGACAACG<br>CCCTGCAGAGCGGCAACAGCCAGGAGAGCGTCAC<br>CGAGCAGGACAGCAAGGACTCCACCTACAGCCTG<br>AGCAGCACCCTGACCCTGAGCAAGGCCGACTACG<br>AGAAGCATAAGGTGTACGCCTGCGAGGTGACCCA<br>CCAGGGGCCTGTCCAGCCCCGTGACCAAGAGCTTCA |

TABLE 1-continued

Sequences of Exemplary Monoclonal Antibodies (MABs) and Antibody Fragments (FABs) That Bind Human ENTPD2

ACAGGGGCGAGTGC

ANTI-HUMAN
ENTPD2 MAB3

| | | | |
|---|---|---|---|
| SEQ ID NO: 1 | HCDR1 (KABAT) | | DYNMD |
| SEQ ID NO: 2 | HCDR2 (KABAT) | | DINPKYDISTYNQQFKG |
| SEQ ID NO: 3 | HCDR3 (KABAT) | | RGFFLYYGINYYYFDV |
| SEQ ID NO: 4 | HCDR1 (CHOTHIA) | | GYTFTDY |
| SEQ ID NO: 5 | HCDR2 (CHOTHIA) | | NPKYDI |
| SEQ ID NO: 3 | HCDR3 (CHOTHIA) | | RGFFLYYGINYYYFDV |
| SEQ ID NO: 6 | HCDR1 (COMBINED) | | GYTFTDYNMD |
| SEQ ID NO: 2 | HCDR2 (COMBINED) | | DINPKYDISTYNQQFKG |
| SEQ ID NO: 3 | HCDR3 (COMBINED) | | RGFFLYYGINYYYFDV |
| SEQ ID NO: 7 | HCDR1 (IMGT) | | GYTFTDYN |
| SEQ ID NO: 8 | HCDR2 (IMGT) | | INPKYDIS |
| SEQ ID NO: 9 | HCDR3 (IMGT) | | ARRGFFLYYGINYYYFDV |
| SEQ ID NO: 33 | VH | | QVQLVQSGAEVVKPGASVKISCKASGYTFTDYNMD WVKQAPGQRLEWIGDINPKYDISTYNQQFKGKATIT VDTSASTAYMELSSLRSEDTAVYYCARRGFFLYYGI NYYYFDVWGQGTLVTVSS |
| SEQ ID NO: 34 | VH DNA | | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACACCTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCC |
| SEQ ID NO: 35 | HC | | QVQLVQSGAEVVKPGASVKISCKASGYTFTDYNMD WVKQAPGQRLEWIGDINPKYDISTYNQQFKGKATIT VDTSASTAYMELSSLRSEDTAVYYCARRGFFLYYGI NYYYFDVWGQGTLVTVSSASTKGPSVFPLAPSSKSTS GGTAALGCLVKDYFPEPVTVSWNSGALTSGVHTFPA VLQSSGLYSLSSVVTVPSSSLGTQTYICNVNHKPSNT KVDKRVEPKSCDKTHTCPPCPAPELLGGPSVFLFPPK PKDTLMISRTPEVTCVVVDVSHEDPEVKFNVYYDGV EVHNAKTKPREEQYNSTYRVVSVLTVLHQDWLNGK EYKCKVSNKALPAPIEKTISKAKGQPREPQVYTLPPS REEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| SEQ ID NO: 36 | HC DNA | | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACACCTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCCGCTAGCAC CAAGGGCCCAAGTGTGTTTCCCCTGGCCCCCAGCA GCAAGTCTACTTCCGGCGGAACTGCTGCCCTGGGT TGCCTGGTGAAGGACTACTTCCCCGAGCCCGTGAC |

TABLE 1-continued

Sequences of Exemplary Monoclonal Antibodies (MABs) and
Antibody Fragments (FABs) That Bind Human ENTPD2

|  |  |  |
|---|---|---|
|  |  | AGTGTCCTGGAACTCTGGGGCTCTGACTTCCGGCG<br>TGCACACCTTCCCCGCCGTGCTGCAGAGCAGCGGC<br>CTGTACAGCCTGAGCAGCGTGGTGACAGTGCCCTC<br>CAGCTCTCTGGGAACCCAGACCTATATCTGCAACG<br>TGAACCACAAGCCCAGCAACACCAAGGTGGACAA<br>GAGAGTGGAGCCCAAGAGCTGCGACAAGACCCAC<br>ACCTGCCCCCCCTGCCCAGCTCCAGAACTGCTGGG<br>AGGGCCTTCCGTGTTCCTGTTCCCCCCCAAGCCCA<br>AGGACACCCTGATGATCAGCAGGACCCCCGAGGT<br>GACCTGCGTGGTGGTGGACGTGTCCCACGAGGACC<br>CAGAGGTGAAGTTCAACTGGTACGTGGACGGCGT<br>GGAGGTGCACAACGCCAAGACCAAGCCCAGAGAG<br>GAGCAGTACAACAGCACCTACAGGGTGGTGTCCGT<br>GCTGACCGTGCTGCACCAGGACTGGCTGAACGGCA<br>AAGAATACAAGTGCAAAGTCTCCAACAAGGCCCT<br>GCCAGCCCCAATCGAAAAGACAATCAGCAAGGCC<br>AAGGGCCAGCCACGGGAGCCCCAGGTGTACACCC<br>TGCCCCCCAGCCGGGAGGAGATGACCAAGAACCA<br>GGTGTCCCTGACCTGTCTGGTGAAGGGCTTCTACC<br>CCAGCGATATCGCCGTGGAGTGGGAGAGCAACGG<br>CCAGCCCGAGAACAACTACAAGACCACCCCCCCA<br>GTGCTGGACAGCGACGGCAGCTTCTTCCTGTACAG<br>CAAGCTGACCGTGGACAAGTCCAGGTGGCAGCAG<br>GGCAACGTGTTCAGCTGCAGCGTGATGCACGAGGC<br>CCTGCACAACCACTACACCCAGAAGTCCCTGAGCC<br>TGAGCCCCGGCAAG |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 18 | LCDR2 (CHOTHIA) | STS |
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 29 | VL | EIVLTQSPATLSASPGERITLSCSASSSVSYIHWYQQK<br>PGQAPRLLIYSTSNLASGIPARFSGSGSGTFYTLTISSV<br>EPEDAAVYYCHQWSSYPWTFGGGTKLEIK |
| SEQ ID NO: 30 | VL DNA | GAGATCGTGCTGACCCAGTCCCCTGCCACCCTGTC<br>TGCCAGCCCTGGCGAGCGGATCACCCTGTCCTGCT<br>CCGCCTCCTCCTCCGTGTCCTACATCCACTGGTATC<br>AGCAGAAGCCCGGCCAGGCCCCTCGGCTGCTGATC<br>TACTCCACCTCCAACCTGGCCTCCGGCATCCCTGC<br>CAGATTCTCCGGCTCTGGCTCCGGCACCTTTTACAC<br>CCTGACCATCTCCAGCGTGGAACCCGAGGACGCCG<br>CCGTGTACTACTGCCACCAGTGGTCCAGCTACCCC<br>TGGACCTTCGGCGGAGGCACCAAGCTGGAAATCA<br>AG |
| SEQ ID NO: 31 | LC | EIVLTQSPATLSASPGERITLSCSASSSVSYIHWYQQK<br>PGQAPRLLIYSTSNLASGIPARFSGSGSGTFYTLTISSV<br>EPEDAAVYYCHQWSSYPWTFGGGTKLEIKRTVAAPS<br>VFIFPPSDEQLKSGTASVVCLLNNFYPREAKVQWKV<br>DNALQSGNSQESVTEQDSKDSTYSLSSTLTLSKADYE<br>KHKVYACEVTHQGLSSPVTKSFNRGEC |

TABLE 1-continued

Sequences of Exemplary Monoclonal Antibodies (MABs) and
Antibody Fragments (FABs) That Bind Human ENTPD2

| SEQ ID NO: 32 | LC DNA | GAGATCGTGCTGACCCAGTCCCCTGCCACCCTGTC<br>TGCCAGCCCTGGCGAGCGGATCACCCTGTCCTGCT<br>CCGCCTCCTCCTCCGTGTCCTACATCCACTGGTATC<br>AGCAGAAGCCCGGCCAGGCCCCTCGGCTGCTGATC<br>TACTCCACCTCCAACCTGGCCTCCGGCATCCCTGC<br>CAGATTCTCCGGCTCTGGCTCCGGCACCTTTTACAC<br>CCTGACCATCTCCAGCGTGGAACCCGAGGACGCCG<br>CCGTGTACTACTGCCACCAGTGGTCCAGCTACCCC<br>TGGACCTTCGGCGGAGGCACCAAGCTGGAAATCA<br>AGCGTACGGTGGCCGCTCCCAGCGTGTTCATCTTC<br>CCCCCAGCGACGAGCAGCTGAAGAGTGGCACCG<br>CCAGCGTGGTGTGCCTGCTGAACAACTTCTACCCC<br>CGGGAGGCCAAGGTGCAGTGGAAGGTGGACAACG<br>CCCTGCAGAGCGGCAACAGCCAGGAGAGCGTCAC<br>CGAGCAGGACAGCAAGGACTCCACCTACAGCCTG<br>AGCAGCACCCTGACCCTGAGCAAGGCCGACTACG<br>AGAAGCATAAGGTGTACGCCTGCGAGGTGACCCA<br>CCAGGGCCTGTCCAGCCCCGTGACCAAGAGCTTCA<br>ACAGGGGCGAGTGC |

ANTI-HUMAN
ENTPD2 MAB4

| SEQ ID NO: 37 | HCDR1 (KABAT) | SGYYWN |
| SEQ ID NO: 38 | HCDR2 (KABAT) | YISYDADNNYNPSLKN |
| SEQ ID NO: 39 | HCDR3 (KABAT) | GYYRYGLGSYRGSYYYVMDY |
| SEQ ID NO: 40 | HCDR1 (CHOTHIA) | GYSITSGY |
| SEQ ID NO: 41 | HCDR2 (CHOTHIA) | SYDAD |
| SEQ ID NO: 39 | HCDR3 (CHOTHIA) | GYYRYGLGSYRGSYYYVMDY |
| SEQ ID NO: 42 | HCDR1 (COMBINED) | GYSITSGYYWN |
| SEQ ID NO: 38 | HCDR2 (COMBINED) | YISYDADNNYNPSLKN |
| SEQ ID NO: 39 | HCDR3 (COMBINED) | GYYRYGLGSYRGSYYYVMDY |
| SEQ ID NO: 43 | HCDR1 (IMGT) | GYSITSGYY |
| SEQ ID NO: 44 | HCDR2 (IMGT) | ISYDADN |
| SEQ ID NO: 45 | HCDR3 (IMGT) | AGGYYRYGLGSYRGSYYYVMDY |
| SEQ ID NO: 46 | VH | QIQLQESGPGLVKPSQTLSLTCTVSGYSITSGYYWNW<br>IRQHPGKGLEWIGYISYDADNNYNPSLKNRVTISRDT<br>SKNQFSLKLSSVTAADTAVYYCAGGYYRYGLGSYR<br>GSYYYVMDYWGQGTTVTVSS |
| SEQ ID NO: 47 | VH DNA | CAGATCCAGCTGCAGGAATCTGGCCCTGGCCTGGT<br>GAAACCCTCCCAGACCCTGTCCCTGACCTGCACCG<br>TGTCCGGCTACTCCATCACCTCCGGCTACTACTGG<br>AACTGGATCCGGCAGCACCCCGGCAAGGGCCTGG<br>AATGGATCGGCTACATCTCCTACGACGCTGACAAC<br>AACTACAACCCCAGCCTGAAGAACAGAGTGACCA<br>TCTCCCGGGACACCTCCAAGAACCAGTTCTCCCTG<br>AAGCTGTCCTCCGTGACCGCCGCTGACACCGCCGT<br>GTACTACTGCGCTGGCGGCTACTACAGATACGGCC<br>TGGGCTCCTACCGGGGCTCCTACTACTACGTGATG<br>GACTACTGGGGCCAGGGCACCACCGTGACCGTGTC<br>CTCT |
| SEQ ID NO: 48 | HC | QIQLQESGPGLVKPSQTLSLTCTVSGYSITSGYYWNW<br>IRQHPGKGLEWIGYISYDADNNYNPSLKNRVTISRDT<br>SKNQFSLKLSSVTAADTAVYYCAGGYYRYGLGSYR<br>GSYYYVMDYWGQGTTVTVSSASTKGPSVFPLAPSSK<br>STSGGTAALGCLVKDYFPEPVTVSWNSGALTSGVHT<br>FPAVLQSSGLYSLSSVVTVPSSSLGTQTYICNVNHKPS<br>NTKVDKRVEPKSCDKTHTCPPCPAPELLGGPSVFLFP<br>PKPKDTLMISRTPEVTCVVVDVSHEDPEVKFNWYVD |

TABLE 1-continued

Sequences of Exemplary Monoclonal Antibodies (MABs) and
Antibody Fragments (FABs) That Bind Human ENTPD2

|  |  |  |
|---|---|---|
|  |  | GVEVHNAKTKPREEQYNSTYRVVSVLTVLHQDWLN GKEYKCKVSNKALPAPIEKTISKAKGQPREPQVYTLP PSREEMTKNQVSLTCLVKGFYPSDIAVEWESNGQPE NNYKTTPPVLDSDGSFFLYSKLTVDKSRWQQGNVFS CSVMHEALHNHYTQKSLSLSPGK |
| SEQ ID NO: 49 | HC DNA | CAGATCCAGCTGCAGGAATCTGGCCCTGGCCTGGT GAAACCCTCCCAGACCCTGTCCCTGACCTGCACCG TGTCCGGCTACTCCATCACCTCCGGCTACTACTGG AACTGGATCCGGCAGCACCCCGGCAAGGGCCTGG AATGGATCGGCTACATCTCCTACGACGCTGACAAC AACTACAACCCCAGCCTGAAGAACAGAGTGACCA TCTCCCGGGACACCTCCAAGAACCAGTTCTCCCTG AAGCTGTCCTCCGTGACCGCCGCTGACACCGCCGT GTACTACTGCGCTGGCGGCTACTACAGATACGGCC TGGGCTCCTACCGGGGCTCCTACTACTACGTGATG GACTACTGGGGCCAGGGCACCACCGTGACCGTGTC CTCTGCTAGCACCAAGGGCCCAAGTGTGTTTCCCC TGGCCCCCAGCAGCAAGTCTACTTCCGGCGGAACT GCTGCCCTGGGTTGCCTGGTGAAGGACTACTTCCC CGAGCCCGTGACAGTGTCCTGGAACTCTGGGGCTC TGACTTCCGGCGTGCACACCTTCCCCGCCGTGCTG CAGAGCAGCGGCCTGTACAGCCTGAGCAGCGTGG TGACAGTGCCCTCCAGCTCTCTGGGAACCCAGACC TATATCTGCAACGTGAACCACAAGCCCAGCAACAC CAAGGTGGACAAGAGAGTGGAGCCCAAGAGCTGC GACAAGACCCACACCTGCCCCCCTGCCCAGCTCC AGAACTGCTGGGAGGGCCTTCCGTGTTCCTGTTCC CCCCCAAGCCCAAGGACACCCTGATGATCAGCAG GACCCCCGAGGTGACCTGCGTGGTGGTGGACGTGT CCCACGAGGACCCAGAGGTGAAGTTCAACTGGTA CGTGGACGGCGTGGAGGTGCACAACGCCAAGACC AAGCCCAGAGAGGAGCAGTACAACAGCACCTACA GGGTGGTGTCCGTGCTGACCGTGCTGCACCAGGAC TGGCTGAACGGCAAAGAATACAAGTGCAAAGTCT CCAACAAGGCCCTGCCAGCCCCAATCGAAAAGAC AATCAGCAAGGCCAAGGGCCAGCCACGGGAGCCC CAGGTGTACACCCTGCCCCCCAGCCGGGAGGAGAT GACCAAGAACCAGGTGTCCCTGACCTGTCTGGTGA AGGGCTTCTACCCCAGCGATATCGCCGTGGAGTGG GAGAGCAACGGCCAGCCCGAGAACAACTACAAGA CCACCCCCCCAGTGCTGGACAGCGACGGCAGCTTC TTCCTGTACAGCAAGCTGACCGTGGACAAGTCCAG GTGGCAGCAGGGCAACGTGTTCAGCTGCAGCGTG ATGCACGAGGCCCTGCACAACCACTACACCCAGA AGTCCCTGAGCCTGAGCCCCGGCAAG |
| SEQ ID NO: 50 | LCDR1 (KABAT) | KASQSVDYEGHSYMN |
| SEQ ID NO: 51 | LCDR2 (KABAT) | AASNLES |
| SEQ ID NO: 52 | LCDR3 (KABAT) | QQSNEDPPT |
| SEQ ID NO: 53 | LCDR1 (CHOTHIA) | SQSVDYEGHSY |
| SEQ ID NO: 54 | LCDR2 (CHOTHIA) | AAS |
| SEQ ID NO: 55 | LCDR3 (CHOTHIA) | SNEDPP |
| SEQ ID NO: 50 | LCDR1 (COMBINED) | KASQSVDYEGHSYMN |
| SEQ ID NO: 51 | LCDR2 (COMBINED) | AASNLES |
| SEQ ID NO: 52 | LCDR3 (COMBINED) | QQSNEDPPT |
| SEQ ID NO: 56 | LCDR1 (IMGT) | QSVDYEGHSY |
| SEQ ID NO: 54 | LCDR2 (IMGT) | AAS |
| SEQ ID NO: 52 | LCDR3 (IMGT) | QQSNEDPPT |
| SEQ ID NO: 57 | VL | ETVLTQSPATLSVSPGERATISCKASQSVDYEGHSYM NWYQQKPGQAPRLLIYAASNLESGIPARFSGSGSGTD FTLTISSVEPEDAATYYCQQSNEDPPTFGGGTKLEIK |

TABLE 1-continued

Sequences of Exemplary Monoclonal Antibodies (MAbs) and
Antibody Fragments (FABs) That Bind Human ENTPD2

| SEQ ID NO: 58 | VL DNA | GAGACAGTGCTGACCCAGTCCCTGCCACCCTGTC
CGTGTCTCCCGGCGAGAGAGCCACCATCAGCTGCA
AGGCCTCCCAGTCCGTGGACTACGAAGGCCATTCC
TACATGAACTGGTATCAGCAGAAGCCCGGCCAGG
CCCCTCGGCTGCTGATCTACGCCGCCTCCAACCTG
GAATCCGGCATCCCTGCCCGGTTCTCCGGCTCTGG
CTCTGGCACCGACTTCACCCTGACCATCTCCAGCG
TGGAACCCGAGGACGCCGCCACCTACTACTGCCAG
CAGTCCAACGAGGACCCCCCCACCTTCGGCGGAGG
CACCAAGCTGGAAATCAAG |
| SEQ ID NO: 59 | LC | ETVLTQSPATLSVSPGERATISCKASQSVDYEGHSYM
NWYQQKPGQAPRLLIYAASNLESGIPARFSGSGSGTD
FTLTISSVEPEDAATYYCQQSNEDPPTFGGGTKLEIKR
TVAAPSVFIFPPSDEQLKSGTASVVCLLNNFYPREAK
VQWKVDNALQSGNSQESVTEQDSKDSTYSLSSTLTL
SKADYEKHKVYACEVTHQGLSSPVTKSFNRGEC |
| SEQ ID NO: 60 | LC DNA | GAGACAGTGCTGACCCAGTCCCTGCCACCCTGTC
CGTGTCTCCCGGCGAGAGAGCCACCATCAGCTGCA
AGGCCTCCCAGTCCGTGGACTACGAAGGCCATTCC
TACATGAACTGGTATCAGCAGAAGCCCGGCCAGG
CCCCTCGGCTGCTGATCTACGCCGCCTCCAACCTG
GAATCCGGCATCCCTGCCCGGTTCTCCGGCTCTGG
CTCTGGCACCGACTTCACCCTGACCATCTCCAGCG
TGGAACCCGAGGACGCCGCCACCTACTACTGCCAG
CAGTCCAACGAGGACCCCCCCACCTTCGGCGGAGG
CACCAAGCTGGAAATCAAGCGTACGGTGGCCGCTC
CCAGCGTGTTCATCTTCCCCCCCAGCGACGAGCAG
CTGAAGAGTGGCACCGCCAGCGTGGTGTGCCTGCT
GAACAACTTCTACCCCGGGAGGCCAAGGTGCAGT
GGAAGGTGGACAACGCCCTGCAGAGCGGCAACAG
CCAGGAGAGCGTCACCGAGCAGGACAGCAAGGAC
TCCACCTACAGCCTGAGCAGCACCCTGACCCTGAG
CAAGGCCGACTACGAGAAGCATAAGGTGTACGCC
TGCGAGGTGACCCACCAGGGCCTGTCCAGCCCCGT
GACCAAGAGCTTCAACAGGGGCGAGTGC |

ANTI-HUMAN
ENTPD2 MAB5

| SEQ ID NO: 37 | HCDR1 (KABAT) | SGYYWN |
| SEQ ID NO: 38 | HCDR2 (KABAT) | YISYDADNNYNPSLKN |
| SEQ ID NO: 39 | HCDR3 (KABAT) | GYYRYGLGSYRGSYYYVMDY |
| SEQ ID NO: 40 | HCDR1 (CHOTHIA) | GYSITSGY |
| SEQ ID NO: 41 | HCDR2 (CHOTHIA) | SYDAD |
| SEQ ID NO: 39 | HCDR3 (CHOTHIA) | GYYRYGLGSYRGSYYYVMDY |
| SEQ ID NO: 42 | HCDR1 (COMBINED) | GYSITSGYYWN |
| SEQ ID NO: 38 | HCDR2 (COMBINED) | YISYDADNNYNPSLKN |
| SEQ ID NO: 39 | HCDR3 (COMBINED) | GYYRYGLGSYRGSYYYVMDY |
| SEQ ID NO: 43 | HCDR1 (IMGT) | GYSITSGYY |
| SEQ ID NO: 44 | HCDR2 (IMGT) | ISYDADN |
| SEQ ID NO: 45 | HCDR3 (IMGT) | AGGYYRYGLGSYRGSYYYVMDY |
| SEQ ID NO: 46 | VH | QIQLQESGPGLVKPSQTLSLTCTVSGYSITSGYYWNW
IRQHPGKGLEWIGYISYDADNNYNPSLKNRVTISRDT
SKNQFSLKLSSVTAADTAVYYCAGGYYRYGLGSYR
GSYYYVMDYWGQGTTVTVSS |
| SEQ ID NO: 47 | VH DNA | CAGATCCAGCTGCAGGAATCTGGCCCTGGCCTGGT
GAAACCCTCCCAGACCCTGTCCCTGACCTGCACCG
TGTCCGGCTACTCCATCACCTCCGGCTACTACTGG |

TABLE 1-continued

Sequences of Exemplary Monoclonal Antibodies (MABs) and
Antibody Fragments (FABs) That Bind Human ENTPD2

|  |  |  |
|---|---|---|
|  |  | AACTGGATCCGGCAGCACCCCGGCAAGGGCCTGG<br>AATGGATCGGCTACATCTCCTACGACGCTGACAAC<br>AACTACAACCCCAGCCTGAAGAACAGAGTGACCA<br>TCTCCCGGGACACCTCCAAGAACCAGTTCTCCCTG<br>AAGCTGTCCTCCGTGACCGCCGCTGACACCGCCGT<br>GTACTACTGCGCTGGCGGCTACTACAGATACGGCC<br>TGGGCTCCTACCGGGGCTCCTACTACTACGTGATG<br>GACTACTGGGGCCAGGGCACCACCGTGACCGTGTC<br>CTCT |
| SEQ ID NO: 48 | HC | QIQLQESGPGLVKPSQTLSLTCTVSGYSITSGYYWNW<br>IRQHPGKGLEWIGYISYDADNNYNPSLKNRVTISRDT<br>SKNQFSLKLSSVTAADTAVYYCAGGYYRYGLGSYR<br>GSYYYVMDYWGQGTTVTVSSASTKGPSVFPLAPSSK<br>STSGGTAALGCLVKDYFPEPVTVSWNSGALTSGVHT<br>FPAVLQSSGLYSLSSVVTVPSSSLGTQTYICNVNHKPS<br>NTKVDKRVEPKSCDKTHTCPPCPAPELLGGPSVFLFP<br>PKPKDTLMISRTPEVTCVVVDVSHEDPEVKFNWYVD<br>GVEVHNAKTKPREEQYNSTYRVVSVLTVLHQDWLN<br>GKEYKCKVSNKALPAPIEKTISKAKGQPREPQVYTLP<br>PSREEMTKNQVSLTCLVKGFYPSDIAVEWESNGQPE<br>NNYKTTPPVLDSDGSFFLYSKLTVDKSRWQQGNVFS<br>CSVMHEALHNHYTQKSLSLSPGK |
| SEQ ID NO: 49 | HC DNA | CAGATCCAGCTGCAGGAATCTGGCCCTGGCCTGGT<br>GAAACCCTCCCAGACCCTGTCCCTGACCTGCACCG<br>TGTCCGGCTACTCCATCACCTCCGGCTACTACTGG<br>AACTGGATCCGGCAGCACCCCGGCAAGGGCCTGG<br>AATGGATCGGCTACATCTCCTACGACGCTGACAAC<br>AACTACAACCCCAGCCTGAAGAACAGAGTGACCA<br>TCTCCCGGGACACCTCCAAGAACCAGTTCTCCCTG<br>AAGCTGTCCTCCGTGACCGCCGCTGACACCGCCGT<br>GTACTACTGCGCTGGCGGCTACTACAGATACGGCC<br>TGGGCTCCTACCGGGGCTCCTACTACTACGTGATG<br>GACTACTGGGGCCAGGGCACCACCGTGACCGTGTC<br>CTCTGCTAGCACCAAGGGCCCAAGTGTGTTTCCCC<br>TGGCCCCCAGCAGCAAGTCTACTTCCGGCGGAACT<br>GCTGCCCTGGGTTGCCTGGTGAAGGACTACTTCCC<br>CGAGCCCGTGACAGTGTCCTGGAACTCTGGGGCTC<br>TGACTTCCGGCGTGCACACCTTCCCCGCCGTGCTG<br>CAGAGCAGCGGCCTGTACAGCCTGAGCAGCGTGG<br>TGACAGTGCCCTCCAGCTCTCTGGGAACCCAGACC<br>TATATCTGCAACGTGAACCACAAGCCCAGCAACAC<br>CAAGGTGGACAAGAGAGTGGAGCCCAAGAGCTGC<br>GACAAGACCCACACCTGCCCCCCCTGCCCAGCTCC<br>AGAACTGCTGGGAGGGCCTTCCGTGTTCCTGTTCC<br>CCCCCAAGCCCAAGGACACCCTGATGATCAGCAG<br>GACCCCCGAGGTGACCTGCGTGGTGGTGGACGTGT<br>CCCACGAGGACCCAGAGGTGAAGTTCAACTGGTA<br>CGTGGACGGCGTGGAGGTGCACAACGCCAAGACC<br>AAGCCCAGAGAGGAGCAGTACAACAGCACCTACA<br>GGGTGGTGTCCGTGCTGACCGTGCTGCACCAGGAC<br>TGGCTGAACGGCAAAGAATACAAGTGCAAAGTCT<br>CCAACAAGGCCCTGCCAGCCCCAATCGAAAAGAC<br>AATCAGCAAGGCCAAGGGCCAGCCACGGGAGCCC<br>CAGGTGTACACCCTGCCCCCCAGCCGGGAGGAGAT<br>GACCAAGAACCAGGTGTCCCTGACCTGTCTGGTGA<br>AGGGCTTCTACCCCAGCGATATCGCCGTGGAGTGG<br>GAGAGCAACGGCCAGCCCGAGAACAACTACAAGA<br>CCACCCCCCAGTGCTGGACAGCGACGGCAGCTTC<br>TTCCTGTACAGCAAGCTGACCGTGGACAAGTCCAG<br>GTGGCAGCAGGGCAACGTGTTCAGCTGCAGCGTG<br>ATGCACGAGGCCCTGCACAACCACTACACCCAGA<br>AGTCCCTGAGCCTGAGCCCCGGCAAG |
| SEQ ID NO: 61 | LCDR1 (KABAT) | KASQSVDYDGNSYMN |
| SEQ ID NO: 51 | LCDR2 (KABAT) | AASNLES |
| SEQ ID NO: 52 | LCDR3 (KABAT) | QQSNEDPPT |
| SEQ ID NO: 62 | LCDR1 (CHOTHIA) | SQSVDYDGNSY |
| SEQ ID NO: 54 | LCDR2 (CHOTHIA) | AAS |
| SEQ ID NO: 55 | LCDR3 (CHOTHIA) | SNEDPP |

TABLE 1-continued

Sequences of Exemplary Monoclonal Antibodies (MAbs) and
Antibody Fragments (FABs) That Bind Human ENTPD2

| SEQ ID NO: 61 | LCDR1 (COMBINED) | KASQSVDYDGNSYMN |
|---|---|---|
| SEQ ID NO: 51 | LCDR2 (COMBINED) | AASNLES |
| SEQ ID NO: 52 | LCDR3 (COMBINED) | QQSNEDPPT |
| SEQ ID NO: 63 | LCDR1 (IMGT) | QSVDYDGNSY |
| SEQ ID NO: 54 | LCDR2 (IMGT) | AAS |
| SEQ ID NO: 52 | LCDR3 (IMGT) | QQSNEDPPT |
| SEQ ID NO: 64 | VL | ETVLTQSPATLSVSPGERATISCKASQSVDYDGNSYM NWYQQKPGQAPRLLIYAASNLESGIPARFSGSGSGTD FTLTISSVEPEDAATYYCQQSNEDPPTFGGGTKLEIK |
| SEQ ID NO: 65 | VL DNA | GAGACAGTGCTGACCCAGTCCCTGCCACCCTGTC CGTGTCTCCCGGCGAGAGAGCCACCATCAGCTGCA AGGCCTCCCAGTCCGTGGACTACGACGGCAACTCC TACATGAACTGGTATCAGCAGAAGCCCGGCCAGG CCCCTCGGCTGCTGATCTACGCCGCCTCCAACCTG GAATCCGGCATCCCTGCCCGGTTCTCCGGCTCTGG CTCTGGCACCGACTTCACCCTGACCATCTCCAGCG TGGAACCCGAGGACGCCGCCACCTACTACTGCCAG CAGTCCAACGAGGACCCCCCCACCTTCGGCGGAGG CACCAAGCTGGAAATCAAG |
| SEQ ID NO: 66 | LC | ETVLTQSPATLSVSPGERATISCKASQSVDYDGNSYM NWYQQKPGQAPRLLIYAASNLESGIPARFSGSGSGTD FTLTISSVEPEDAATYYCQQSNEDPPTFGGGTKLEIKR TVAAPSVFIFPPSDEQLKSGTASVVCLLNNFYPREAK VQWKVDNALQSGNSQESVTEQDSKDSTYSLSSTLTL SKADYEKHKVYACEVTHQGLSSPVTKSFNRGEC |
| SEQ ID NO: 67 | LC DNA | GAGACAGTGCTGACCCAGTCCCTGCCACCCTGTC CGTGTCTCCCGGCGAGAGAGCCACCATCAGCTGCA AGGCCTCCCAGTCCGTGGACTACGACGGCAACTCC TACATGAACTGGTATCAGCAGAAGCCCGGCCAGG CCCCTCGGCTGCTGATCTACGCCGCCTCCAACCTG GAATCCGGCATCCCTGCCCGGTTCTCCGGCTCTGG CTCTGGCACCGACTTCACCCTGACCATCTCCAGCG TGGAACCCGAGGACGCCGCCACCTACTACTGCCAG CAGTCCAACGAGGACCCCCCCACCTTCGGCGGAGG CACCAAGCTGGAAATCAAGCGTACGGTGGCCGCTC CCAGCGTGTTCATCTTCCCCCCCAGCGACGAGCAG CTGAAGAGTGGCACCGCCAGCGTGGTGTGCCTGCT GAACAACTTCTACCCCCGGGAGGCCAAGGTGCAGT GGAAGGTGGACAACGCCCTGCAGAGCGGCAACAG CCAGGAGAGCGTCACCGAGCAGGACAGCAAGGAC TCCACCTACAGCCTGAGCAGCACCCTGACCCTGAG CAAGGCCGACTACGAGAAGCATAAGGTGTACGCC TGCGAGGTGACCCACCAGGGCCTGTCCAGCCCCGT GACCAAGAGCTTCAACAGGGGCGAGTGC |

| ANTI-HUMAN ENTPD2 MAB6 | | |
|---|---|---|
| SEQ ID NO: 37 | HCDR1 (KABAT) | SGYYWN |
| SEQ ID NO: 38 | HCDR2 (KABAT) | YISYDADNNYNPSLKN |
| SEQ ID NO: 68 | HCDR3 (KABAT) | GYYRYGLGSYSGSYYYVMDY |
| SEQ ID NO: 40 | HCDR1 (CHOTHIA) | GYSITSGY |
| SEQ ID NO: 41 | HCDR2 (CHOTHIA) | SYDAD |
| SEQ ID NO: 68 | HCDR3 (CHOTHIA) | GYYRYGLGSYSGSYYYVMDY |
| SEQ ID NO: 42 | HCDR1 (COMBINED) | GYSITSGYYWN |
| SEQ ID NO: 38 | HCDR2 (COMBINED) | YISYDADNNYNPSLKN |

TABLE 1-continued

Sequences of Exemplary Monoclonal Antibodies (MABs) and
Antibody Fragments (FABs) That Bind Human ENTPD2

| SEQ ID NO: 68 | HCDR3 (COMBINED) | GYYRYGLGSYSGSYYYVMDY |
|---|---|---|
| SEQ ID NO: 43 | HCDR1 (IMGT) | GYSITSGYY |
| SEQ ID NO: 44 | HCDR2 (IMGT) | ISYDADN |
| SEQ ID NO: 69 | HCDR3 (IMGT) | AGGYYRYGLGSYSGSYYYVMDY |
| SEQ ID NO: 70 | VH | QVQLQESGPGLVKPSQTLSLTCTVSGYSITSGYYWN WIRQHPGKGLEWMGYISYDADNNYNPSLKNRITISR DTSKNQFSLKLSSVTAADTAVYYCAGGYYRYGLGS YSGSYYYVMDYWGQGTTVTVSS |
| SEQ ID NO: 71 | VH DNA | CAGGTGCAGCTGCAGGAATCTGGCCCTGGCCTGGT GAAACCCTCCCAGACCCTGTCCCTGACCTGCACCG TGTCCGGCTACTCCATCACCTCCGGCTACTACTGG AACTGGATCCGGCAGCACCCCGGCAAGGGCCTGG AATGGATGGGCTACATCTCCTACGACGCTGACAAC AACTACAACCCCAGCCTGAAGAACAGAATCACCA TCTCCCGGGACACCTCCAAGAACCAGTTCTCCCTG AAGCTGTCCTCCGTGACCGCCGCTGACACCGCCGT GTACTACTGCGCTGGCGGCTACTACAGATACGGCC TGGGCTCCTACTCCGGCTCCTACTACTACGTGATG GACTACTGGGGCCAGGGCACCACCGTGACCGTGTC CTCT |
| SEQ ID NO: 72 | HC | QVQLQESGPGLVKPSQTLSLTCTVSGYSITSGYYWN WIRQHPGKGLEWMGYISYDADNNYNPSLKNRITISR DTSKNQFSLKLSSVTAADTAVYYCAGGYYRYGLGS YSGSYYYVMDYWGQGTTVTVSSASTKGPSVFPLAPS SKSTSGGTAALGCLVKDYFPEPVTVSWNSGALTSGV HTFPAVLQSSGLYSLSSVVTVPSSSLGTQTYICNVNH KPSNTKVDKRVEPKSCDKTHTCPPCPAPELLGGPSVF LFPPKPKDTLMISRTPEVTCVVVDVSHEDPEVKFNW YVDGVEVHNAKTKPREEQYNSTYRVVSVLTVLHQD WLNGKEYKCKVSNKALPAPIEKTISKAKGQPREPQV YTLPPSREEMTKNQVSLTCLVKGFYPSDIAVEWESN GQPENNYKTTPPVLDSDGSFFLYSKLTVDKSRWQQG NVFSCSVMHEALHNHYTQKSLSLSPGK |
| SEQ ID NO: 73 | HC DNA | CAGGTGCAGCTGCAGGAATCTGGCCCTGGCCTGGT GAAACCCTCCCAGACCCTGTCCCTGACCTGCACCG TGTCCGGCTACTCCATCACCTCCGGCTACTACTGG AACTGGATCCGGCAGCACCCCGGCAAGGGCCTGG AATGGATGGGCTACATCTCCTACGACGCTGACAAC AACTACAACCCCAGCCTGAAGAACAGAATCACCA TCTCCCGGGACACCTCCAAGAACCAGTTCTCCCTG AAGCTGTCCTCCGTGACCGCCGCTGACACCGCCGT GTACTACTGCGCTGGCGGCTACTACAGATACGGCC TGGGCTCCTACTCCGGCTCCTACTACTACGTGATG GACTACTGGGGCCAGGGCACCACCGTGACCGTGTC CTCTGCTAGCACCAAGGGCCCAAGTGTGTTTCCCC TGGCCCCCAGCAGCAAGTCTACTTCCGGCGGAACT GCTGCCCTGGGTTGCCTGGTGAAGGACTACTTCCC CGAGCCCGTGACAGTGTCCTGGAACTCTGGGGCTC TGACTTCCGGCGTGCACACCTTCCCCGCCGTGCTG CAGAGCAGCGGCCTGTACAGCCTGAGCAGCGTGG TGACAGTGCCCTCCAGCTCTCTGGGAACCCAGACC TATATCTGCAACGTGAACCACAAGCCCAGCAACAC CAAGGTGGACAAGAGAGTGGAGCCCAAGAGCTGC GACAAGACCCACACCTGCCCCCCCTGCCCAGCTCC AGAACTGCTGGGAGGGCCTTCCGTGTTCCTGTTCC CCCCAAGCCCAAGGACACCCTGATGATCAGCAG GACCCCCGAGGTGACCTGCGTGGTGGTGGACGTGT CCCACGAGGACCCAGAGGTGAAGTTCAACTGGTA CGTGGACGGCGTGGAGGTGCACAACGCCAAGACC AAGCCCAGAGAGGAGCAGTACAACAGCACCTACA GGGTGGTGTCCGTGCTGACCGTGCTGCACCAGGAC TGGCTGAACGGCAAAGAATACAAGTGCAAAGTCT CCAACAAGGCCCTGCCAGCCCCAATCGAAAAGAC AATCAGCAAGGCCAAGGGCCAGCCACGGGAGCCC CAGGTGTACACCCTGCCCCCCAGCCGGGAGGAGAT GACCAAGAACCAGGTGTCCCTGACCTGTCTGGTGA AGGGCTTCTACCCCAGCGATATCGCCGTGGAGTGG GAGAGCAACGGCCAGCCCGAGAACAACTACAAGA |

TABLE 1-continued

Sequences of Exemplary Monoclonal Antibodies (MABs) and
Antibody Fragments (FABs) That Bind Human ENTPD2

| | | |
|---|---|---|
| | | CCACCCCCCAGTGCTGGACAGCGACGGCAGCTTC<br>TTCCTGTACAGCAAGCTGACCGTGGACAAGTCCAG<br>GTGGCAGCAGGGCAACGTGTTCAGCTGCAGCGTG<br>ATGCACGAGGCCCTGCACAACCACTACACCCAGA<br>AGTCCCTGAGCCTGAGCCCCGGCAAG |
| SEQ ID NO: 50 | LCDR1 (KABAT) | KASQSVDYEGHSYMN |
| SEQ ID NO: 51 | LCDR2 (KABAT) | AASNLES |
| SEQ ID NO: 52 | LCDR3 (KABAT) | QQSNEDPPT |
| SEQ ID NO: 53 | LCDR1 (CHOTHIA) | SQSVDYEGHSY |
| SEQ ID NO: 54 | LCDR2 (CHOTHIA) | AAS |
| SEQ ID NO: 55 | LCDR3 (CHOTHIA) | SNEDPP |
| SEQ ID NO: 50 | LCDR1 (COMBINED) | KASQSVDYEGHSYMN |
| SEQ ID NO: 51 | LCDR2 (COMBINED) | AASNLES |
| SEQ ID NO: 52 | LCDR3 (COMBINED) | QQSNEDPPT |
| SEQ ID NO: 56 | LCDR1 (IMGT) | QSVDYEGHSY |
| SEQ ID NO: 54 | LCDR2 (IMGT) | AAS |
| SEQ ID NO: 52 | LCDR3 (IMGT) | QQSNEDPPT |
| SEQ ID NO: 74 | VL | DTQMTQSPSSLSVSVGDRATITCKASQSVDYEGHSY<br>MNWYQQKPGKAPKLLIYAASNLESGVPSRFSGSGSG<br>TDFTLTISSVQPEDFATYYCQQSNEDPPTFGGGTKLEI<br>K |
| SEQ ID NO: 75 | VL DNA | GACACCCAGATGACCCAGTCCCCCTCCTCCCTGTC<br>CGTGTCCGTGGGCGACAGAGCCACCATCACATGCA<br>AGGCCTCCCAGTCCGTGGACTACGAAGGCCATTCC<br>TACATGAACTGGTATCAGCAGAAGCCCGGCAAGG<br>CCCCCAAGCTGCTGATCTACGCCGCCTCCAACCTG<br>GAATCCGGCGTGCCCTCCAGATTCTCCGGCTCCGG<br>CTCTGGCACCGACTTCACCCTGACCATCTCCAGCG<br>TGCAGCCCGAGGACTTCGCCACCTACTACTGCCAG<br>CAGTCCAACGAGGACCCCCCCACCTTCGGCGGAGG<br>CACCAAGCTGGAAATCAAG |
| SEQ ID NO: 76 | LC | DTQMTQSPSSLSVSVGDRATITCKASQSVDYEGHSY<br>MNWYQQKPGKAPKLLIYAASNLESGVPSRFSGSGSG<br>TDFTLTISSVQPEDEATYYCQQSNEDPPTFGGGTKLEI<br>KRTVAAPSVFIFPPSDEQLKSGTASVVCLLNNFYPRE<br>AKVQWKVDNALQSGNSQESVTEQDSKDSTYSLSSTL<br>TLSKADYEKHKVYACEVTHQGLSSPVTKSFNRGEC |
| SEQ ID NO: 77 | LC DNA | GACACCCAGATGACCCAGTCCCCCTCCTCCCTGTC<br>CGTGTCCGTGGGCGACAGAGCCACCATCACATGCA<br>AGGCCTCCCAGTCCGTGGACTACGAAGGCCATTCC<br>TACATGAACTGGTATCAGCAGAAGCCCGGCAAGG<br>CCCCCAAGCTGCTGATCTACGCCGCCTCCAACCTG<br>GAATCCGGCGTGCCCTCCAGATTCTCCGGCTCCGG<br>CTCTGGCACCGACTTCACCCTGACCATCTCCAGCG<br>TGCAGCCCGAGGACTTCGCCACCTACTACTGCCAG<br>CAGTCCAACGAGGACCCCCCCACCTTCGGCGGAGG<br>CACCAAGCTGGAAATCAAGCGTACGGTGGCCGCTC<br>CCAGCGTGTTCATCTTCCCCCCCAGCGACGAGCAG<br>CTGAAGAGTGGCACCGCCAGCGTGGTGTGCCTGCT<br>GAACAACTTCTACCCCCGGGAGGCCAAGGTGCAGT<br>GGAAGGTGGACAACGCCCTGCAGAGCGGCAACAG<br>CCAGGAGAGCGTCACCGAGCAGGACAGCAAGGAC<br>TCCACCTACAGCCTGAGCAGCACCCTGACCCTGAG<br>CAAGGCCGACTACGAGAAGCATAAGGTGTACGCC<br>TGCGAGGTGACCCACCAGGGCCTGTCCAGCCCCGT<br>GACCAAGAGCTTCAACAGGGGCGAGTGC |

TABLE 1-continued

Sequences of Exemplary Monoclonal Antibodies (MAbs) and
Antibody Fragments (FAbs) That Bind Human ENTPD2

ANTI-HUMAN
ENTPD2 MAB7

| SEQ ID NO: 1 | HCDR1 (KABAT) | DYNMD |
| --- | --- | --- |
| SEQ ID NO: 2 | HCDR2 (KABAT) | DINPKYDISTYNQQFKG |
| SEQ ID NO: 3 | HCDR3 (KABAT) | RGFFLYYGINYYYFDV |
| SEQ ID NO: 4 | HCDR1 (CHOTHIA) | GYTFTDY |
| SEQ ID NO: 5 | HCDR2 (CHOTHIA) | NPKYDI |
| SEQ ID NO: 3 | HCDR3 (CHOTHIA) | RGFFLYYGINYYYFDV |
| SEQ ID NO: 6 | HCDR1 (COMBINED) | GYTFTDYNMD |
| SEQ ID NO: 2 | HCDR2 (COMBINED) | DINPKYDISTYNQQFKG |
| SEQ ID NO: 3 | HCDR3 (COMBINED) | RGFFLYYGINYYYFDV |
| SEQ ID NO: 7 | HCDR1 (IMGT) | GYTFTDYN |
| SEQ ID NO: 8 | HCDR2 (IMGT) | INPKYDIS |
| SEQ ID NO: 9 | HCDR3 (IMGT) | ARRGFFLYYGINYYYFDV |
| SEQ ID NO: 25 | VH | QVQLVQSGAEVVKPGASVKISCKASGYTFTDYNMD WVKQAPGQRLEWIGDINPKYDISTYNQQFKGKATIT VDKSASTAYMELSSLRSEDTAVYYCARRGFFLYYGI NYYYFDVWGQGTLVTVSS |
| SEQ ID NO: 26 | VH DNA | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACAAGTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCC |
| SEQ ID NO: 27 | HC | QVQLVQSGAEVVKPGASVKISCKASGYTFTDYNMD WVKQAPGQRLEWIGDINPKYDISTYNQQFKGKATIT VDKSASTAYMELSSLRSEDTAVYYCARRGFFLYYGI NYYYFDVWGQGTLVTVSSASTKGPSVFPLAPSSKSTS GGTAALGCLVKDYFPEPVTVSWNSGALTSGVHTFPA VLQSSGLYSLSSVVTVPSSSLGTQTYICNVNHKPSNT KVDKRVEPKSCDKTHTCPPCPAPELLGGPSVFLFPPK PKDTLMISRTPEVTCVVVDVSHEDPEVKFNWYVDGV EVHNAKTKPREEQYNSTYRVVSVLTVLHQDWLNGK EYKCKVSNKALPAPIEKTISKAKGQPREPQVYTLPPS REEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| SEQ ID NO: 28 | HC DNA | CAGGTGCAGCTGGTGCAGTCTGGCGCCGAGGTGGT GAAACCTGGCGCCTCCGTGAAGATCTCCTGCAAGG CCTCCGGCTACACCTTCACCGACTACAACATGGAC TGGGTGAAACAGGCCCCTGGCCAGCGGCTGGAAT GGATCGGCGACATCAACCCTAAGTACGACATCTCC ACCTACAACCAGCAGTTCAAGGGCAAGGCCACCA TCACCGTGGACAAGTCCGCCTCCACCGCCTACATG GAACTGTCCTCCCTGCGGAGCGAGGACACCGCCGT GTACTACTGCGCCAGACGGGGCTTCTTCCTGTACT ACGGCATCAACTACTACTACTTCGACGTGTGGGGC CAGGGCACCCTGGTGACAGTGTCCTCCGCTAGCAC CAAGGGCCCAAGTGTGTTTCCCCTGGCCCCCAGCA GCAAGTCTACTTCCGGCGGAACTGCTGCCCTGGGT TGCCTGGTGAAGGACTACTTCCCCGAGCCCGTGAC AGTGTCCTGGAACTCTGGGGCTCTGACTTCCGGCG TGCACACCTTCCCCGCCGTGCTGCAGAGCAGCGGC |

TABLE 1-continued

Sequences of Exemplary Monoclonal Antibodies (MABs) and
Antibody Fragments (FABs) That Bind Human ENTPD2

| | | |
|---|---|---|
| | | CTGTACAGCCTGAGCAGCGTGGTGACAGTGCCCTC
CAGCTCTCTGGGAACCCAGACCTATATCTGCAACG
TGAACCACAAGCCCAGCAACACCAAGGTGGACAA
GAGAGTGGAGCCCAAGAGCTGCGACAAGACCCAC
ACCTGCCCCCCCTGCCCAGCTCCAGAACTGCTGGG
AGGGCCTTCCGTGTTCCTGTTCCCCCCCAAGCCCA
AGGACACCCTGATGATCAGCAGGACCCCCGAGGT
GACCTGCGTGGTGGTGGACGTGTCCCACGAGGACC
CAGAGGTGAAGTTCAACTGGTACGTGGACGGCGT
GGAGGTGCACAACGCCAAGACCAAGCCCAGAGAG
GAGCAGTACAACAGCACCTACAGGGTGGTGTCCGT
GCTGACCGTGCTGCACCAGGACTGGCTGAACGGCA
AGGAATACAAGTGCAAAGTCTCCAACAAGGCCCT
GCCAGCCCCAATCGAAAAGACAATCAGCAAGGCC
AAGGGCCAGCCACGGGAGCCCCAGGTGTACACCC
TGCCCCCCAGCCGGGAGGAGATGACCAAGAACCA
GGTGTCCCTGACCTGTCTGGTGAAGGGCTTCTACC
CCAGCGATATCGCCGTGGAGTGGGAGAGCAACGG
CCAGCCCGAGAACAACTACAAGACCACCCCCCCA
GTGCTGGACAGCGACGGCAGCTTCTTCCTGTACAG
CAAGCTGACCGTGGACAAGTCCAGGTGGCAGCAG
GGCAACGTGTTCAGCTGCAGCGTGATGCACGAGGC
CCTGCACAACCACTACACCCAGAAGTCCCTGAGCC
TGAGCCCCGGCAAG |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 18 | LCDR2 (CHOTHIA) | STS |
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 78 | VL | EIVLTQSPATLSASPGEEITLSCSASSSVSYIHWYQQK
PGQAPRLLIYSTSNLASGIPARFSGSGSGTFYTLTISSV
EPEDAAVYYCHQWSSYPWTFGGGTKLEIK |
| SEQ ID NO: 79 | VL DNA | GAGATCGTGCTGACCCAGTCCCCTGCCACCCTGTC
TGCCAGCCCTGGCGAGGAGATCACCCTGTCCTGCT
CCGCCTCCTCCTCCGTGTCCTACATCCACTGGTATC
AGCAGAAGCCCGGCCAGGCCCCTCGGCTGCTGATC
TACTCCACCTCCAACCTGGCCTCCGGCATCCCTGC
CAGATTCTCCGGCTCTGGCTCCGGCACCTTTTACAC
CCTGACCATCTCCAGCGTGGAACCCGAGGACGCCG
CCGTGTACTACTGCCACCAGTGGTCCAGCTACCCC
TGGACCTTCGGCGGAGGCACCAAGCTGGAAATCA
AG |
| SEQ ID NO: 80 | LC | EIVLTQSPATLSASPGEEITLSCSASSSVSYIHWYQQK
PGQAPRLLIYSTSNLASGIPARFSGSGSGTFYTLTISSV
EPEDAAVYYCHQWSSYPWTFGGGTKLEIKRTVAAPS
VFIFPPSDEQLKSGTASVVCLLNNFYPREAKVQWKV
DNALQSGNSQESVTEQDSKDSTYSLSSTLTLSKADYE
KHKVYACEVTHQGLSSPVTKSFNRGEC |
| SEQ ID NO: 81 | LC DNA | GAGATCGTGCTGACCCAGTCCCCTGCCACCCTGTC
TGCCAGCCCTGGCGAGGAGATCACCCTGTCCTGCT
CCGCCTCCTCCTCCGTGTCCTACATCCACTGGTATC |

TABLE 1-continued

Sequences of Exemplary Monoclonal Antibodies (MABs) and
Antibody Fragments (FABs) That Bind Human ENTPD2

|  |  |  |
|---|---|---|
|  |  | AGCAGAAGCCCGGCCAGGCCCCTCGGCTGCTGATC<br>TACTCCACCTCCAACCTGGCCTCCGGCATCCCTGC<br>CAGATTCTCCGGCTCTGGCTCCGGCACCTTTTACAC<br>CCTGACCATCTCCAGCGTGGAACCCGAGGACGCCG<br>CCGTGTACTACTGCCACCAGTGGTCCAGCTACCCC<br>TGGACCTTCGGCGGAGGCACCAAGCTGGAAATCA<br>AGCGTACGGTGGCCGCTCCCAGCGTGTTCATCTTC<br>CCCCCCAGCGACGAGCAGCTGAAGAGTGGCACCG<br>CCAGCGTGGTGTGCCTGCTGAACAACTTCTACCCC<br>CGGGAGGCCAAGGTGCAGTGGAAGGTGGACAACG<br>CCCTGCAGAGCGGCAACAGCCAGGAGAGCGTCAC<br>CGAGCAGGACAGCAAGGACTCCACCTACAGCCTG<br>AGCAGCACCCTGACCCTGAGCAAGGCCGACTACG<br>AGAAGCATAAGGTGTACGCCTGCGAGGTGACCCA<br>CCAGGGCCTGTCCAGCCCCGTGACCAAGAGCTTCA<br>ACAGGGGCGAGTGC |

ANTI-HUMAN
ENTPD2 MAB8

| SEQ ID NO: 82 | HCDR1 (KABAT) | SSSAAWN |
|---|---|---|
| SEQ ID NO: 83 | HCDR2 (KABAT) | RIYYRSKWYNDYAVSVKS |
| SEQ ID NO: 84 | HCDR3 (KABAT) | GSYVTSSYEGFDY |
| SEQ ID NO: 85 | HCDR1 (CHOTHIA) | GDSVSSSSA |
| SEQ ID NO: 86 | HCDR2 (CHOTHIA) | YYRSKWY |
| SEQ ID NO: 84 | HCDR3 (CHOTHIA) | GSYVTSSYEGFDY |
| SEQ ID NO: 87 | HCDR1 (COMBINED) | GDSVSSSSAAWN |
| SEQ ID NO: 83 | HCDR2 (COMBINED) | RIYYRSKWYNDYAVSVKS |
| SEQ ID NO: 84 | HCDR3 (COMBINED) | GSYVTSSYEGFDY |
| SEQ ID NO: 88 | HCDR1 (IMGT) | GDSVSSSSAA |
| SEQ ID NO: 89 | HCDR2 (IMGT) | IYYRSKWYN |
| SEQ ID NO: 90 | HCDR3 (IMGT) | ARGSYVTSSYEGFDY |
| SEQ ID NO: 91 | VH | QVQLQQSGPGLVKPSQTLSLTCAISGDSVSSSSAAWN<br>WIRQSPSRGLEWLGRIYYRSKWYNDYAVSVKSRITIN<br>PDTSKNQFSLQLNSVTPEDTAVYYCARGSYVTSSYE<br>GFDYWGQGTLVTVSS |
| SEQ ID NO: 92 | VH DNA | CAGGTGCAATTGCAGCAGAGCGGTCCGGGCCTGGT<br>GAAACCGAGCCAGACCCTGAGCCTGACCTGCGCG<br>ATTTCCGGAGATAGCGTGAGCTCTAGCTCTGCTGC<br>TTGGAACTGGATTCGTCAGAGCCCGAGCCGTGGCC<br>TCGAGTGGCTGGGCCGTATCTACTACCGTAGCAAA<br>TGGTACAACGACTATGCCGTGAGCGTGAAAAGCC<br>GCATTACCATTAACCCGGATACTTCGAAAAACCAG<br>TTTAGCCTGCAACTGAACAGCGTGACCCCGGAAGA<br>TACGGCCGTGTATTATTGCGCGCGTGGTTCTTACGT<br>TACTTCTTCTTACGAAGGTTTCGATTACTGGGGCCA<br>AGGCACCCTGGTGACTGTTAGCTCA |
| SEQ ID NO: 93 | HC | QVQLQQSGPGLVKPSQTLSLTCAISGDSVSSSSAAWN<br>WIRQSPSRGLEWLGRIYYRSKWYNDYAVSVKSRITIN<br>PDTSKNQFSLQLNSVTPEDTAVYYCARGSYVTSSYE<br>GFDYWGQGTLVTVSSASTKGPSVFPLAPSSKSTSGGT<br>AALGCLVKDYFPEPVTVSWNSGALTSGVHTFPAVLQ<br>SSGLYSLSSVVTVPSSSLGTQTYICNVNHKPSNTKVD<br>KRVEPKSCDKTHTCPPCPAPELLGGPSVFLFPPKPKD<br>TLMISRTPEVTCVVVDVSHEDPEVKFNWYVDGVEV<br>HNAKTKPREEQYNSTYRVVSVLTVLHQDWLNGKEY<br>KCKVSNKALPAPIEKTISKAKGQPREPQVYTLPPSREE<br>MTKNQVSLTCLVKGFYPSDIAVEWESNGQPENNYKT<br>TPPVLDSDGSFFLYSKLTVDKSRWQQGNVFSCSVMH<br>EALHNHYTQKSLSLSPGK |

TABLE 1-continued

Sequences of Exemplary Monoclonal Antibodies (MABs) and
Antibody Fragments (FABs) That Bind Human ENTPD2

| SEQ ID NO: 94 | HC DNA | CAGGTGCAATTGCAGCAGAGCGGTCCGGGCCTGGT
GAAACCGAGCCAGACCCTGAGCCTGACCTGCGCG
ATTTCCGGAGATAGCGTGAGCTCTAGCTCTGCTGC
TTGGAACTGGATTCGTCAGAGCCCGAGCCGTGGCC
TCGAGTGGCTGGGCCGTATCTACTACCGTAGCAAA
TGGTACAACGACTATGCCGTGAGCGTGAAAAGCC
GCATTACCATTAACCCGGATACTTCGAAAAACCAG
TTTAGCCTGCAACTGAACAGCGTGACCCCGGAAGA
TACGGCCGTGTATTATTGCGCGCGTGGTTCTTACGT
TACTTCTTCTTACGAAGGTTTCGATTACTGGGGCCA
AGGCACCCTGGTGACTGTTAGCTCAGCCTCCACCA
AGGGTCCATCGGTCTTCCCCCTGGCACCCTCCTCC
AAGAGCACCTCTGGGGGCACAGCGGCCCTGGGCT
GCCTGGTCAAGGACTACTTCCCCGAACCGGTGACG
GTGTCGTGGAACTCAGGCGCCCTGACCAGCGGCGT
GCACACCTTCCCGGCTGTCCTACAGTCCTCAGGAC
TCTACTCCCTCAGCAGCGTGGTGACCGTGCCCTCC
AGCAGCTTGGGCACCCAGACCTACATCTGCAACGT
GAATCACAAGCCCAGCAACACCAAGGTGGACAAG
AGAGTTGAGCCCAAATCTTGTGACAAAACTCACAC
ATGCCCACCGTGCCCAGCACCTGAACTCCTGGGGG
GACCGTCAGTCTTCCTCTTCCCCCCAAAACCCAAG
GACACCCTCATGATCTCCCGGACCCCTGAGGTCAC
ATGCGTGGTGGTGGACGTGAGCCACGAAGACCCT
GAGGTCAAGTTCAACTGGTACGTGGACGGCGTGG
AGGTGCATAATGCCAAGACAAAGCCGCGGGAGGA
GCAGTACAACAGCACGTACCGGGTGGTCAGCGTCC
TCACCGTCCTGCACCAGGACTGGCTGAATGGCAAG
GAGTACAAGTGCAAGGTCTCCAACAAAGCCCTCCC
AGCCCCCATCGAGAAAACCATCTCCAAAGCCAAA
GGGCAGCCCCGAGAACCACAGGTGTACACCCTGC
CCCCATCCCGGGAGGAGATGACCAAGAACCAGGT
CAGCCTGACCTGCCTGGTCAAAGGCTTCTATCCCA
GCGACATCGCCGTGGAGTGGGAGAGCAATGGGCA
GCCGGAGAACAACTACAAGACCACGCCTCCCGTG
CTGGACTCCGACGGCTCCTTCTTCCTCTACAGCAA
GCTCACCGTGGACAAGAGCAGGTGGCAGCAGGGG
AACGTCTTCTCATGCTCCGTGATGCATGAGGCTCT
GCACAACCACTACACGCAGAAGAGCCTCTCCCTGT
CTCCGGGTAAA |
| SEQ ID NO: 95 | LCDR1 (KABAT) | SGDNLPEKYAY |
| SEQ ID NO: 96 | LCDR2 (KABAT) | DDNKRPS |
| SEQ ID NO: 97 | LCDR3 (KABAT) | QSYGKWGWTWV |
| SEQ ID NO: 98 | LCDR1 (CHOTHIA) | DNLPEKY |
| SEQ ID NO: 99 | LCDR2 (CHOTHIA) | DDN |
| SEQ ID NO: 100 | LCDR3 (CHOTHIA) | YGKWGWTW |
| SEQ ID NO: 95 | LCDR1 (COMBINED) | SGDNLPEKYAY |
| SEQ ID NO: 96 | LCDR2 (COMBINED) | DDNKRPS |
| SEQ ID NO: 97 | LCDR3 (COMBINED) | QSYGKWGWTWV |
| SEQ ID NO: 101 | LCDR1 (IMGT) | NLPEKY |
| SEQ ID NO: 99 | LCDR2 (IMGT) | DDN |
| SEQ ID NO: 97 | LCDR3 (IMGT) | QSYGKWGWTWV |
| SEQ ID NO: 102 | VL | SYELTQPLSVSVALGQTARITCSGDNLPEKYAYWYQ
QKPGQAPVLVIYDDNKRPSGIPERFSGSNSGNTATLTI
SRAQAGDEADYYCQSYGKWGWTWVFGGGTKLTVL |
| SEQ ID NO: 103 | VL DNA | AGCTACGAACTGACCCAGCCGCTGTCCGTGAGCGT
GGCTCTGGGCCAGACCGCGCGGATTACCTGTAGCG
GCGATAACCTGCCGGAAAAATACGCTTACTGGTAC
CAGCAGAAACCGGGCCAGGCGCCGGTGCTGGTGA |

TABLE 1-continued

Sequences of Exemplary Monoclonal Antibodies (MABs) and
Antibody Fragments (FABs) That Bind Human ENTPD2

|   |   |   |
|---|---|---|
|   |   | TCTACGACGACAACAAACGTCCGAGCGGCATCCCG<br>GAACGTTTTAGCGGATCCAACAGCGGCAACACCGC<br>GACCCTGACCATTAGCCGCGCCCAGGCGGGAGAC<br>GAAGCGGATTATTACTGCCAGTCTTACGGTAAATG<br>GGGTTGGACTTGGGTGTTTGGCGGCGGCACGAAGT<br>TAACCGTCCTA |
| SEQ ID NO: 104 | LC | SYELTQPLSVSVALGQTARITCSGDNLPEKYAYWYQ<br>QKPGQAPVLVIYDDNKRPSGIPERFSGSNSGNTATLTI<br>SRAQAGDEADYYCQSYGKWGWTWVFGGGTKLTVL<br>GQPKAAPSVTLFPPSSEELQANKATLVCLISDFYPGA<br>VTVAWKADSSPVKAGVETTTPSKQSNNKYAASSYLS<br>LTPEQWKSHRSYSCQVTHEGSTVEKTVAPTECS |
| SEQ ID NO: 105 | LC DNA | AGCTACGAACTGACCCAGCCGCTGTCCGTGAGCGT<br>GGCTCTGGGCCAGACCGCGCGGATTACCTGTAGCG<br>GCGATAACCTGCCGGAAAAATACGCTTACTGGTAC<br>CAGCAGAAACGGGCCAGGCGCCGGTGCTGGTGA<br>TCTACGACGACAACAAACGTCCGAGCGGCATCCCG<br>GAACGTTTTAGCGGATCCAACAGCGGCAACACCGC<br>GACCCTGACCATTAGCCGCGCCCAGGCGGGAGAC<br>GAAGCGGATTATTACTGCCAGTCTTACGGTAAATG<br>GGGTTGGACTTGGGTGTTTGGCGGCGGCACGAAGT<br>TAACCGTCCTAGGTCAGCCCAAGGCTGCCCCCTCG<br>GTCACTCTGTTCCCGCCCTCCTCTGAGGAGCTTCAA<br>GCCAACAAGGCCACACTGGTGTGTCTCATAAGTGA<br>CTTCTACCCGGGAGCCGTGACAGTGGCCTGGAAGG<br>CAGATAGCAGCCCCGTCAAGGCGGGAGTGGAGAC<br>CACCACACCCTCCAAACAAAGCAACAACAAGTAC<br>GCGGCCAGCAGCTATCTGAGCCTGACGCCTGAGCA<br>GTGGAAGTCCCACAGAAGCTACAGCTGCCAGGTC<br>ACGCATGAAGGGAGCACCGTGGAGAAGACAGTGG<br>CCCCTACAGAATGTTCA |

ANTI-HUMAN
ENTPD2 MAB9

| SEQ ID NO: 106 | HCDR1 (KABAT) | SYAVS |
| SEQ ID NO: 107 | HCDR2 (KABAT) | RIVPWLGHTQYAQKFQG |
| SEQ ID NO: 108 | HCDR3 (KABAT) | ESPGYRYSFDV |
| SEQ ID NO: 109 | HCDR1 (CHOTHIA) | GGTFDSY |
| SEQ ID NO: 110 | HCDR2 (CHOTHIA) | VPWLGH |
| SEQ ID NO: 108 | HCDR3 (CHOTHIA) | ESPGYRYSFDV |
| SEQ ID NO: 111 | HCDR1 (COMBINED) | GGTFDSYAVS |
| SEQ ID NO: 107 | HCDR2 (COMBINED) | RIVPWLGHTQYAQKFQG |
| SEQ ID NO: 108 | HCDR3 (COMBINED) | ESPGYRYSFDV |
| SEQ ID NO: 112 | HCDR1 (IMGT) | GGTFDSYA |
| SEQ ID NO: 113 | HCDR2 (IMGT) | IVPWLGHT |
| SEQ ID NO: 114 | HCDR3 (IMGT) | ARESPGYRYSFDV |
| SEQ ID NO: 115 | VH | QVQLVQSGAEVKKPGSSVKVSCKASGGTFDSYAVS<br>WVRQAPGQGLEWMGRIVPWLGHTQYAQKFQGRVTI<br>TADESTSTAYMELSSLRSEDTAVYYCARESPGYRYSF<br>DVWDQGTLVTVSS |
| SEQ ID NO: 116 | VH DNA | CAGGTGCAATTGGTGCAGAGCGGTGCCGAAGTGA<br>AAAAACCGGGCAGCAGCGTGAAAGTTAGCTGCAA<br>AGCATCCGGAGGGACGTTTGACTCTTACGCTGTTT<br>CTTGGGTGCGCCAGGCCCCGGGCCAGGGCCTCGAG<br>TGGATGGGCCGTATCGTTCCGTGGCTGGGCCATAC<br>TCAGTACGCCCAGAAATTTCAGGGCCGGGTGACCA<br>TTACCGCCGATGAAAGCACCAGCACCGCCTATATG<br>GAACTGAGCAGCCTGCGCAGCGAAGATACGGCCG |

TABLE 1-continued

Sequences of Exemplary Monoclonal Antibodies (MABs) and Antibody Fragments (FABs) That Bind Human ENTPD2

| | | |
|---|---|---|
| | | TGTATTATTGCGCGCGTGAATCTCCGGGTTACCGTT<br>ACTCTTTCGATGTTTGGGACCAAGGCACCCTGGTG<br>ACTGTTAGCTCA |
| SEQ ID NO: 117 | HC | QVQLVQSGAEVKKPGSSVKVSCKASGGTFDSYAVS<br>WVRQAPGQGLEWMGRIVPWLGHTQYAQKFQGRVTI<br>TADESTSTAYMELSSLRSEDTAVYYCARESPGYRYSF<br>DVWDQGTLVTVSSASTKGPSVFPLAPSSKSTSGGTA<br>ALGCLVKDYFPEPVTVSWNSGALTSGVHTFPAVLQS<br>SGLYSLSSVVTVPSSSLGTQTYICNVNHKPSNTKVDK<br>RVEPKSCDKTHTCPPCPAPELLGGPSVFLFPPKPKDTL<br>MISRTPEVTCVVVDVSHEDPEVKFNWYVDGVEVHN<br>AKTKPREEQYNSTYRVVSVLTVLHQDWLNGKEYKC<br>KVSNKALPAPIEKTISKAKGQPREPQVYTLPPSREEM<br>TKNQVSLTCLVKGFYPSDIAVEWESNGQPENNYKTT<br>PPVLDSDGSFFLYSKLTVDKSRWQQGNVFSCSVMHE<br>ALHNHYTQKSLSLSPGK |
| SEQ ID NO: 118 | HC DNA | CAGGTGCAATTGGTGCAGAGCGGTGCCGAAGTGA<br>AAAAACCGGGCAGCAGCGTGAAAGTTAGCTGCAA<br>AGCATCCGGAGGGACGTTTGACTCTTACGCTGTTT<br>CTTGGGTGCGCCAGGCCCCGGGCCAGGGCCTCGAG<br>TGGATGGGCCGTATCGTTCCGTGGCTGGGCCATAC<br>TCAGTACGCCCAGAAATTTCAGGGCCGGGTGACCA<br>TTACCGCCGATGAAAGCACCAGCACCGCCTATATG<br>GAACTGAGCAGCCTGCGCAGCGAAGATACGGCCG<br>TGTATTATTGCGCGCGTGAATCTCCGGGTTACCGTT<br>ACTCTTTCGATGTTTGGGACCAAGGCACCCTGGTG<br>ACTGTTAGCTCAGCCTCCACCAAGGGTCCATCGGT<br>CTTCCCCCTGGCACCCTCCTCCAAGAGCACCTCTG<br>GGGGCACAGCGGCCCTGGGCTGCCTGGTCAAGGA<br>CTACTTCCCCGAACCGGTGACGGTGTCGTGGAACT<br>CAGGCGCCCTGACCAGCGGCGTGCACACCTTCCCG<br>GCTGTCCTACAGTCCTCAGGACTCTACTCCCTCAG<br>CAGCGTGGTGACCGTGCCCTCCAGCAGCTTGGGCA<br>CCCAGACCTACATCTGCAACGTGAATCACAAGCCC<br>AGCAACACCAAGGTGGACAAGAGAGTTGAGCCCA<br>AATCTTGTGACAAAACTCACACATGCCCACCGTGC<br>CCAGCACCTGAACTCCTGGGGGGACCGTCAGTCTT<br>CCTCTTCCCCCCAAAACCCAAGGACACCCTCATGA<br>TCTCCCGGACCCCTGAGGTCACATGCGTGGTGGTG<br>GACGTGAGCCACGAAGACCCTGAGGTCAAGTTCA<br>ACTGGTACGTGGACGGCGTGGAGGTGCATAATGCC<br>AAGACAAAGCCGCGGGAGGAGCAGTACAACAGCA<br>CGTACCGGGTGGTCAGCGTCCTCACCGTCCTGCAC<br>CAGGACTGGCTGAATGGCAAGGAGTACAAGTGCA<br>AGGTCTCCAACAAAGCCCTCCCAGCCCCCATCGAG<br>AAAACCATCTCCAAAGCCAAAGGGCAGCCCCGAG<br>AACCACAGGTGTACACCCTGCCCCCATCCCGGGAG<br>GAGATGACCAAGAACCAGGTCAGCCTGACCTGCCT<br>GGTCAAAGGCTTCTATCCCAGCGACATCGCCGTGG<br>AGTGGGAGAGCAATGGGCAGCCGGAGAACAACTA<br>CAAGACCACGCCTCCCGTGCTGGACTCCGACGGCT<br>CCTTCTTCCTCTACAGCAAGCTCACCGTGGACAAG<br>AGCAGGTGGCAGCAGGGGAACGTCTTCTCATGCTC<br>CGTGATGCATGAGGCTCTGCACAACCACTACACGC<br>AGAAGAGCCTCTCCCTGTCTCCGGGTAAA |
| SEQ ID NO: 119 | LCDR1 (KABAT) | SGDAIGEKYVY |
| SEQ ID NO: 120 | LCDR2 (KABAT) | DDNNRPS |
| SEQ ID NO: 121 | LCDR3 (KABAT) | ASYDLQQARWV |
| SEQ ID NO: 122 | LCDR1 (CHOTHIA) | DAIGEKY |
| SEQ ID NO: 99 | LCDR2 (CHOTHIA) | DDN |
| SEQ ID NO: 123 | LCDR3 (CHOTHIA) | YDLQQARW |
| SEQ ID NO: 119 | LCDR1 (COMBINED) | SGDAIGEKYVY |
| SEQ ID NO: 120 | LCDR2 (COMBINED) | DDNNRPS |

TABLE 1-continued

Sequences of Exemplary Monoclonal Antibodies (MAbs) and
Antibody Fragments (FABs) That Bind Human ENTPD2

| SEQ ID NO: 121 | LCDR3 (COMBINED) | ASYDLQQARWV |
| SEQ ID NO: 124 | LCDR1 (IMGT) | AIGEKY |
| SEQ ID NO: 99 | LCDR2 (IMGT) | DDN |
| SEQ ID NO: 121 | LCDR3 (IMGT) | ASYDLQQARWV |
| SEQ ID NO: 125 | VL | SYELTQPLSVSVALGQTARITCSGDAIGEKYVYWYQ QKPGQAPVLVIYDDNNRPSGIPERFSGSNSGNTATLTI SRAQAGDEADYYCASYDLQQARWVFGGGTKLTVL |
| SEQ ID NO: 126 | VL DNA | AGCTACGAACTGACCCAGCCGCTGTCCGTGAGCGT GGCTCTGGGCCAGACCGCGCGGATTACCTGTAGCG GCGATGCTATCGGTGAAAAATACGTTTACTGGTAC CAGCAGAAACCGGGCCAGGCGCCGGTGCTGGTGA TCTACGACGACAACAACCGTCCGAGCGGCATCCCG GAACGTTTTAGCGGATCCAACAGCGGCAACACCGC GACCCTGACCATTAGCCGCGCCCAGGCGGGAGAC GAAGCGGATTATTACTGCGCTTCTTACGACCTGCA GCAGGCTCGTTGGGTGTTTGGCGGCGGCACGAAGT TAACCGTCCTA |
| SEQ ID NO: 127 | LC | SYELTQPLSVSVALGQTARITCSGDAIGEKYVYWYQ QKPGQAPVLVIYDDNNRPSGIPERFSGSNSGNTATLTI SRAQAGDEADYYCASYDLQQARWVFGGGTKLTVL GQPKAAPSVTLFPPSSEELQANKATLVCLISDFYPGA VTVAWKADSSPVKAGVETTTPSKQSNNKYAASSYLS LTPEQWKSHRSYSCQVTHEGSTVEKTVAPTECS |
| SEQ ID NO: 128 | LC DNA | AGCTACGAACTGACCCAGCCGCTGTCCGTGAGCGT GGCTCTGGGCCAGACCGCGCGGATTACCTGTAGCG GCGATGCTATCGGTGAAAAATACGTTTACTGGTAC CAGCAGAAACCGGGCCAGGCGCCGGTGCTGGTGA TCTACGACGACAACAACCGTCCGAGCGGCATCCCG GAACGTTTTAGCGGATCCAACAGCGGCAACACCGC GACCCTGACCATTAGCCGCGCCCAGGCGGGAGAC GAAGCGGATTATTACTGCGCTTCTTACGACCTGCA GCAGGCTCGTTGGGTGTTTGGCGGCGGCACGAAGT TAACCGTCCTAGGTCAGCCCAAGGCTGCCCCCTCG GTCACTCTGTTCCCGCCCTCCTCTGAGGAGCTTCAA GCCAACAAGGCCACACTGGTGTGTCTCATAAGTGA CTTCTACCCGGGAGCCGTGACAGTGGCCTGGAAGG CAGATAGCAGCCCCGTCAAGGCGGGAGTGGAGAC CACCACACCCTCCAAACAAAGCAACAACAAGTAC GCGGCCAGCAGCTATCTGAGCCTGACGCCTGAGCA GTGGAAGTCCCACAGAAGCTACAGCTGCCAGGTC ACGCATGAAGGGAGCACCGTGGAGAAGACAGTGG CCCCTACAGAATGTTCA |

| ANTI-HUMAN ENTPD2 MAB10 | | |
| --- | --- | --- |
| SEQ ID NO: 106 | HCDR1 (KABAT) | SYAVS |
| SEQ ID NO: 129 | HCDR2 (KABAT) | RIVPWLGFTRYAQKFQG |
| SEQ ID NO: 108 | HCDR3 (KABAT) | ESPGYRYSFDV |
| SEQ ID NO: 109 | HCDR1 (CHOTHIA) | GGTFDSY |
| SEQ ID NO: 130 | HCDR2 (CHOTHIA) | VPWLGF |
| SEQ ID NO: 108 | HCDR3 (CHOTHIA) | ESPGYRYSFDV |
| SEQ ID NO: 111 | HCDR1 (COMBINED) | GGTFDSYAVS |
| SEQ ID NO: 129 | HCDR2 (COMBINED) | RIVPWLGFTRYAQKFQG |
| SEQ ID NO: 108 | HCDR3 (COMBINED) | ESPGYRYSFDV |
| SEQ ID NO: 112 | HCDR1 (IMGT) | GGTFDSYA |

TABLE 1-continued

Sequences of Exemplary Monoclonal Antibodies (MABs) and
Antibody Fragments (FABs) That Bind Human ENTPD2

| SEQ ID NO: 131 | HCDR2 (IMGT) | IVPWLGFT |
|---|---|---|
| SEQ ID NO: 114 | HCDR3 (IMGT) | ARESPGYRYSFDV |
| SEQ ID NO: 132 | VH | QVQLVQSGAEVKKPGSSVKVSCKASGGTFDSYAVS WVRQAPGQGLEWMGRIVPWLGFTRYAQKFQGRVTI TADESTSTAYMELSSLRSEDTAVYYCARESPGYRYSF DVWDQGTLVTVSS |
| SEQ ID NO: 133 | VH DNA | CAGGTGCAATTGGTGCAGAGCGGTGCCGAAGTGA AAAAACCGGGCAGCAGCGTGAAAGTTAGCTGCAA AGCATCCGGAGGGACGTTTGACTCTTACGCTGTTT CTTGGGTGCGCCAGGCCCCGGGCCAGGGCCTCGAG TGGATGGGCCGTATCGTTCCGTGGCTGGGCTTCAC TCGTTACGCCCAGAAATTTCAGGGCCGGGTGACCA TTACCGCCGATGAAAGCACCAGCACCGCCTATATG GAACTGAGCAGCCTGCGCAGCGAAGATACGGCCG TGTATTATTGCGCGCGTGAATCTCCGGGTTACCGTT ACTCTTTCGATGTTTGGGACCAAGGCACCCTGGTG ACTGTTAGCTCA |
| SEQ ID NO: 134 | HC | QVQLVQSGAEVKKPGSSVKVSCKASGGTFDSYAVS WVRQAPGQGLEWMGRIVPWLGFTRYAQKFQGRVTI TADESTSTAYMELSSLRSEDTAVYYCARESPGYRYSF DVWDQGTLVTVSSASTKGPSVFPLAPSSKSTSGGTA ALGCLVKDYFPEPVTVSWNSGALTSGVHTFPAVLQS SGLYSLSSVVTVPSSSLGTQTYICNVNHKPSNTKVDK RVEPKSCDKTHTCPPCPAPELLGGPSVFLFPPKPKDTL MISRTPEVTCVVVDVSHEDPEVKFNWYVDGVEVHN AKTKPREEQYNSTYRVVSVLTVLHQDWLNGKEYKC KVSNKALPAPIEKTISKAKGQPREPQVYTLPPSREEM TKNQVSLTCLVKGFYPSDIAVEWESNGQPENNYKTT PPVLDSDGSFFLYSKLTVDKSRWQQGNVFSCSVMHE ALHNHYTQKSLSLSPGK |
| SEQ ID NO: 135 | HC DNA | CAGGTGCAATTGGTGCAGAGCGGTGCCGAAGTGA AAAAACCGGGCAGCAGCGTGAAAGTTAGCTGCAA AGCATCCGGAGGGACGTTTGACTCTTACGCTGTTT CTTGGGTGCGCCAGGCCCCGGGCCAGGGCCTCGAG TGGATGGGCCGTATCGTTCCGTGGCTGGGCTTCAC TCGTTACGCCCAGAAATTTCAGGGCCGGGTGACCA TTACCGCCGATGAAAGCACCAGCACCGCCTATATG GAACTGAGCAGCCTGCGCAGCGAAGATACGGCCG TGTATTATTGCGCGCGTGAATCTCCGGGTTACCGTT ACTCTTTCGATGTTTGGGACCAAGGCACCCTGGTG ACTGTTAGCTCAGCCTCCACCAAGGGTCCATCGGT CTTCCCCCTGGCACCCTCCTCCAAGAGCACCTCTG GGGGCACAGCGGCCCTGGGCTGCCTGGTCAAGGA CTACTTCCCCGAACCGGTGACGGTGTCGTGGAACT CAGGCGCCCTGACCAGCGGCGTGCACACCTTCCCG GCTGTCCTACAGTCCTCAGGACTCTACTCCCTCAG CAGCGTGGTGACCGTGCCCTCCAGCAGCTTGGGCA CCCAGACCTACATCTGCAACGTGAATCACAAGCCC AGCAACACCAAGGTGGACAAGAGAGTTGAGCCCA AATCTTGTGACAAAACTCACACATGCCCACCGTGC CCAGCACCTGAACTCCTGGGGGGACCGTCAGTCTT CCTCTTCCCCCCAAAACCCAAGGACACCCTCATGA TCTCCCGGACCCCTGAGGTCACATGCGTGGTGGTG GACGTGAGCCACGAAGACCCTGAGGTCAAGTTCA ACTGGTACGTGGACGGCGTGGAGGTGCATAATGCC AAGACAAAGCCGCGGGAGGAGCAGTACAACAGCA CGTACCGGGTGGTCAGCGTCCTCACCGTCCTGCAC CAGGACTGGCTGAATGGCAAGGAGTACAAGTGCA AGGTCTCCAACAAAGCCCTCCCAGCCCCCATCGAG AAAACCATCTCCAAAGCCAAAGGGCAGCCCCGAG AACCACAGGTGTACACCCTGCCCCCATCCCGGGAG GAGATGACCAAGAACCAGGTCAGCCTGACCTGCCT GGTCAAAGGCTTCTATCCCAGCGACATCGCCGTGG AGTGGGAGAGCAATGGGCAGCCGGAGAACAACTA CAAGACCACGCCTCCCGTGCTGGACTCCGACGGCT CCTTCTTCCTCTACAGCAAGCTCACCGTGGACAAG AGCAGGTGGCAGCAGGGGAACGTCTTCTCATGCTC CGTGATGCATGAGGCTCTGCACAACCACTACACGC AGAAGAGCCTCTCCCTGTCTCCGGGTAAA |
| SEQ ID NO: 119 | LCDR1 (KABAT) | SGDAIGEKYVY |

TABLE 1-continued

Sequences of Exemplary Monoclonal Antibodies (MABs) and
Antibody Fragments (FABs) That Bind Human ENTPD2

| SEQ ID NO: 120 | LCDR2 (KABAT) | DDNNRPS |
| --- | --- | --- |
| SEQ ID NO: 121 | LCDR3 (KABAT) | ASYDLQQARWV |
| SEQ ID NO: 122 | LCDR1 (CHOTHIA) | DAIGEKY |
| SEQ ID NO: 99 | LCDR2 (CHOTHIA) | DDN |
| SEQ ID NO: 123 | LCDR3 (CHOTHIA) | YDLQQARW |
| SEQ ID NO: 119 | LCDR1 (COMBINED) | SGDAIGEKYVY |
| SEQ ID NO: 120 | LCDR2 (COMBINED) | DDNNRPS |
| SEQ ID NO: 121 | LCDR3 (COMBINED) | ASYDLQQARWV |
| SEQ ID NO: 124 | LCDR1 (IMGT) | AIGEKY |
| SEQ ID NO: 99 | LCDR2 (IMGT) | DDN |
| SEQ ID NO: 121 | LCDR3 (IMGT) | ASYDLQQARWV |
| SEQ ID NO: 125 | VL | SYELTQPLSVSVALGQTARITCSGDAIGEKYVYWYQQKPGQAPVLVIYDDNNRPSGIPERFSGSNSGNTATLTISRAQAGDEADYYCASYDLQQARWVFGGGTKLTVL |
| SEQ ID NO: 126 | VL DNA | AGCTACGAACTGACCCAGCCGCTGTCCGTGAGCGTGGCTCTGGGCCAGACCGCGCGGATTACCTGTAGCGGCGATGCTATCGGTGAAAAATACGTTTACTGGTACCAGCAGAAACCGGGCCAGGCGCCGGTGCTGGTGATCTACGACGACAACAACCGTCCGAGCGGCATCCCGGAACGTTTTAGCGGATCCAACAGCGGCAACACCGCGACCCTGACCATTAGCCGCGCCCAGGCGGGAGACGAAGCGGATTATTACTGCGCTTCTTACGACCTGCAGCAGGCTCGTTGGGTGTTTGGCGGCGGCACGAAGTTAACCGTCCTA |
| SEQ ID NO: 127 | LC | SYELTQPLSVSVALGQTARITCSGDAIGEKYVYWYQQKPGQAPVLVIYDDNNRPSGIPERFSGSNSGNTATLTISRAQAGDEADYYCASYDLQQARWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS |
| SEQ ID NO: 128 | LC DNA | AGCTACGAACTGACCCAGCCGCTGTCCGTGAGCGTGGCTCTGGGCCAGACCGCGCGGATTACCTGTAGCGGCGATGCTATCGGTGAAAAATACGTTTACTGGTACCAGCAGAAACCGGGCCAGGCGCCGGTGCTGGTGATCTACGACGACAACAACCGTCCGAGCGGCATCCCGGAACGTTTTAGCGGATCCAACAGCGGCAACACCGCGACCCTGACCATTAGCCGCGCCCAGGCGGGAGACGAAGCGGATTATTACTGCGCTTCTTACGACCTGCAGCAGGCTCGTTGGGTGTTTGGCGGCGGCACGAAGTTAACCGTCCTAGGTCAGCCCAAGGCTGCCCCCTCGGTCACTCTGTTCCCGCCCTCCTCTGAGGAGCTTCAAGCCAACAAGGCCACACTGGTGTGTCTCATAAGTGACTTCTACCCGGGAGCCGTGACAGTGGCCTGGAAGGCAGATAGCAGCCCCGTCAAGGCGGGAGTGGAGACCACCACACCCTCCAAACAAAGCAACAACAAGTACGCGGCCAGCAGCTATCTGAGCCTGACGCCTGAGCAGTGGAAGTCCCACAGAAGCTACAGCTGCCAGGTCACGCATGAAGGGAGCACCGTGGAGAAGACAGTGGCCCCTACAGAATGTTCA |

| ANTI-HUMAN ENTPD2 MAB11 |
| --- |

| SEQ ID NO: 136 | HCDR1 (KABAT) | SYAMS |
| --- | --- | --- |
| SEQ ID NO: 137 | HCDR2 (KABAT) | VISGSGGSTYYADSVKG |
| SEQ ID NO: 138 | HCDR3 (KABAT) | GDDYGDDYYYYGMDV |

TABLE 1-continued

Sequences of Exemplary Monoclonal Antibodies (MAbs) and
Antibody Fragments (FABs) That Bind Human ENTPD2

| SEQ ID NO: 139 | HCDR1 (CHOTHIA) | GFTFSSY |
| --- | --- | --- |
| SEQ ID NO: 140 | HCDR2 (CHOTHIA) | SGSGGS |
| SEQ ID NO: 138 | HCDR3 (CHOTHIA) | GDDYGDDYYYYGMDV |
| SEQ ID NO: 141 | HCDR1 (COMBINED) | GFTFSYAMSS |
| SEQ ID NO: 137 | HCDR2 (COMBINED) | VISGSGGSTYYADSVKG |
| SEQ ID NO: 138 | HCDR3 (COMBINED) | GDDYGDDYYYYGMDV |
| SEQ ID NO: 142 | HCDR1 (IMGT) | GFTFSSYA |
| SEQ ID NO: 143 | HCDR2 (IMGT) | ISGSGGST |
| SEQ ID NO: 144 | HCDR3 (IMGT) | ARGDDYGDDYYYYGMDV |
| SEQ ID NO: 145 | VH | EVQLLESGGGLVQSGGSLRLSCAASGFTFSSYAMSW VRQAPGKGLEWVSVISGSGGSTYYADSVKGRFTISR DNSKNTLYLQMNSLRAEDTAVYYCARGDDYGDDY YYYGMDVWGQGTTVTVSS |
| SEQ ID NO: 146 | VH DNA | GAGGTGCAGCTGTTGGAGTCTGGGGGAGGCTTGGT ACAGTCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGT GGGTCTCAGTTATTAGTGGTAGTGGTGGTAGCACA TACTACGCAGACTCCGTGAAGGGCCGGTTCACCAT CTCCAGAGACAATTCCAAGAACACGCTGTATCTGC AAATGAACAGCCTGAGAGCCGAGGACACGGCCGT ATATTACTGTGCGAGAGGGGATGACTACGGTGACG ACTACTACTACTACGGTATGGACGTCTGGGGCCAA GGGACCACGGTCACCGTCTCCTCA |
| SEQ ID NO: 147 | HC | EVQLLESGGGLVQSGGSLRLSCAASGFTFSSYAMSW VRQAPGKGLEWVSVISGSGGSTYYADSVKGRFTISR DNSKNTLYLQMNSLRAEDTAVYYCARGDDYGDDY YYYGMDVWGQGTTVTVSSASTKGPSVFPLAPSSKST SGGTAALGCLVKDYFPEPVTVSWNSGALTSGVHTFP AVLQSSGLYSLSSVVTVPSSSLGTQTYICNVNHKPSN TKVDKRVEPKSCDKTHTCPPCPAPELLGGPSVFLFPP KPKDTLMISRTPEVTCVVVDVSHEDPEVKFNWYVDG VEVHNAKTKPREEQYNSTYRVVSVLTVLHQDWLNG KEYKCKVSNKALPAPIEKTISKAKGQPREPQVYTLPP SREEMTKNQVSLTCLVKGFYPSDIAVEWESNGQPEN NYKTTPPVLDSDGSFFLYSKLTVDKSRWQQGNVFSC SVMHEALHNHYTQKSLSLSPGK |
| SEQ ID NO: 148 | HC DNA | GAGGTGCAGCTGTTGGAGTCTGGGGGAGGCTTGGT ACAGTCTGGGGGGTCCCTGAGACTCTCCTGTGCAG CCTCTGGATTCACCTTTAGCAGCTATGCCATGAGC TGGGTCCGCCAGGCTCCAGGGAAGGGGCTGGAGT GGGTCTCAGTTATTAGTGGTAGTGGTGGTAGCACA TACTACGCAGACTCCGTGAAGGGCCGGTTCACCAT CTCCAGAGACAATTCCAAGAACACGCTGTATCTGC AAATGAACAGCCTGAGAGCCGAGGACACGGCCGT ATATTACTGTGCGAGAGGGGATGACTACGGTGACG ACTACTACTACTACGGTATGGACGTCTGGGGCCAA GGGACCACGGTCACCGTCTCCTCAGCTAGCACCAA GGGCCCAAGTGTGTTTCCCCTGGCCCCCAGCAGCA AGTCTACTTCCGGCGGAACTGCTGCCCTGGGTTGC CTGGTGAAGGACTACTTCCCCGAGCCCGTGACAGT GTCCTGGAACTCTGGGGCTCTGACTTCCGGCGTGC ACACCTTCCCCGCCGTGCTGCAGAGCAGCGGCCTG TACAGCCTGAGCAGCGTGGTGACAGTGCCCTCCAG CTCTCTGGGAACCCAGACCTATATCTGCAACGTGA ACCACAAGCCCAGCAACACCAAGGTGGACAAGAG AGTGGAGCCCAAGAGCTGCGACAAGACCCACACC TGCCCCCCCTGCCCAGCTCCAGAACTGCTGGGAGG GCCTTCCGTGTTCCTGTTCCCCCCAAGCCCAAGG ACACCCTGATGATCAGCAGGACCCCCGAGGTGACC TGCGTGGTGGTGGACGTGTCCCACGAGGACCCAGA GGTGAAGTTCAACTGGTACGTGGACGGCGTGGAG |

TABLE 1-continued

Sequences of Exemplary Monoclonal Antibodies (MAbs) and
Antibody Fragments (FABs) That Bind Human ENTPD2

|  |  |  |
| --- | --- | --- |
|  |  | GTGCACAACGCCAAGACCAAGCCCAGAGAGGAGC<br>AGTACAACAGCACCTACAGGGTGGTGTCCGTGCTG<br>ACCGTGCTGCACCAGGACTGGCTGAACGGCAAAG<br>AATACAAGTGCAAAGTCTCCAACAAGGCCCTGCCA<br>GCCCCAATCGAAAAGACAATCAGCAAGGCCAAGG<br>GCCAGCCACGGGAGCCCCAGGTGTACACCCTGCCC<br>CCCAGCCGGGAGGAGATGACCAAGAACCAGGTGT<br>CCCTGACCTGTCTGGTGAAGGGCTTCTACCCCAGC<br>GATATCGCCGTGGAGTGGGAGAGCAACGGCCAGC<br>CCGAGAACAACTACAAGACCACCCCCCCAGTGCTG<br>GACAGCGACGGCAGCTTCTTCCTGTACAGCAAGCT<br>GACCGTGGACAAGTCCAGGTGGCAGCAGGGCAAC<br>GTGTTCAGCTGCAGCGTGATGCACGAGGCCCTGCA<br>CAACCACTACACCCAGAAGTCCCTGAGCCTGAGCC<br>CCGGCAAG |
| SEQ ID NO: 149 | LCDR1 (KABAT) | RSSQSLLHGNRYNYLD |
| SEQ ID NO: 150 | LCDR2 (KABAT) | LGSNRAS |
| SEQ ID NO: 151 | LCDR3 (KABAT) | MQALQTPPT |
| SEQ ID NO: 152 | LCDR1 (CHOTHIA) | SQSLLHGNRYNY |
| SEQ ID NO: 153 | LCDR2 (CHOTHIA) | LGS |
| SEQ ID NO: 154 | LCDR3 (CHOTHIA) | ALQTPP |
| SEQ ID NO: 149 | LCDR1 (COMBINED) | RSSQSLLHGNRYNYLD |
| SEQ ID NO: 150 | LCDR2 (COMBINED) | LGSNRAS |
| SEQ ID NO: 151 | LCDR3 (COMBINED) | MQALQTPPT |
| SEQ ID NO: 155 | LCDR1 (IMGT) | QSLLHGNRYNY |
| SEQ ID NO: 153 | LCDR2 (IMGT) | LGS |
| SEQ ID NO: 151 | LCDR3 (IMGT) | MQALQTPPT |
| SEQ ID NO: 156 | VL | DIVMTQSPLSLPVTPGEPASISCRSSQSLLHGNRYNYL<br>DWYLQKPGQSPQLLIYLGSNRASGVPDRFSGSGSGT<br>DFTLKISRVEAEDVGVYYCMQALQTPPTFGQGTKVE<br>IK |
| SEQ ID NO: 157 | VL DNA | GATATTGTGATGACTCAGTCTCCACTCTCCCTGCCC<br>GTCACCCCTGGAGAGCCGGCCTCCATCTCCTGCAG<br>GTCTAGTCAGAGCCTCCTGCATGGTAATCGATACA<br>ACTATTTGGATTGGTACCTGCAGAAGCCAGGGCAG<br>TCTCCACAGCTCCTGATCTATTTGGGTTCTAATCGG<br>GCCTCCGGGGTCCCTGACAGGTTCAGTGGCAGTGG<br>ATCAGGCACAGATTTTACACTGAAAATCAGCAGAG<br>TGGAGGCTGAGGATGTTGGGGTTTATTACTGCATG<br>CAAGCTCTACAAACTCCTCCGACGTTCGGCCAAGG<br>GACCAAGGTGGAAATCAAA |
| SEQ ID NO: 158 | LC | DIVMTQSPLSLPVTPGEPASISCRSSQSLLHGNRYNYL<br>DWYLQKPGQSPQLLIYLGSNRASGVPDRFSGSGSGT<br>DFTLKISRVEAEDVGVYYCMQALQTPPTFGQGTKVE<br>IKRTVAAPSVFIFPPSDEQLKSGTASVVCLLNNFYPRE<br>AKVQWKVDNALQSGNSQESVTEQDSKDSTYSLSSTL<br>TLSKADYEKHKVYACEVTHQGLSSPVTKSFNRGEC |
| SEQ ID NO: 159 | LC DNA | GATATTGTGATGACTCAGTCTCCACTCTCCCTGCCC<br>GTCACCCCTGGAGAGCCGGCCTCCATCTCCTGCAG<br>GTCTAGTCAGAGCCTCCTGCATGGTAATCGATACA<br>ACTATTTGGATTGGTACCTGCAGAAGCCAGGGCAG<br>TCTCCACAGCTCCTGATCTATTTGGGTTCTAATCGG<br>GCCTCCGGGGTCCCTGACAGGTTCAGTGGCAGTGG<br>ATCAGGCACAGATTTTACACTGAAAATCAGCAGAG<br>TGGAGGCTGAGGATGTTGGGGTTTATTACTGCATG<br>CAAGCTCTACAAACTCCTCCGACGTTCGGCCAAGG<br>GACCAAGGTGGAAATCAAACGAACTGTGGCTGCA<br>CCAAGCGTGTTCATCTTCCCCCCCAGCGACGAGCA |

TABLE 1-continued

Sequences of Exemplary Monoclonal Antibodies (MABs) and
Antibody Fragments (FABs) That Bind Human ENTPD2

|  |  |  |
|---|---|---|
|  |  | GCTGAAGAGTGGCACCGCCAGCGTGGTGTGCCTGC<br>TGAACAACTTCTACCCCCGGGAGGCCAAGGTGCAG<br>TGGAAGGTGGACAACGCCCTGCAGAGCGGCAACA<br>GCCAGGAGAGCGTCACCGAGCAGGACAGCAAGGA<br>CTCCACCTACAGCCTGAGCAGCACCCTGACCCTGA<br>GCAAGGCCGACTACGAGAAGCATAAGGTGTACGC<br>CTGCGAGGTGACCCACCAGGGCCTGTCCAGCCCCG<br>TGACCAAGAGCTTCAACAGGGGCGAGTGC |

ANTI-HUMAN
ENTPD2 MAB12

| SEQ ID NO: 160 | HCDR1 (KABAT) | SCSMN |
|---|---|---|
| SEQ ID NO: 161 | HCDR2 (KABAT) | YISSSSSTIYYADSVKG |
| SEQ ID NO: 162 | HCDR3 (KABAT) | DQGNWNYDDYYNGLDV |
| SEQ ID NO: 163 | HCDR1 (CHOTHIA) | GFTFNSC |
| SEQ ID NO: 164 | HCDR2 (CHOTHIA) | SSSSST |
| SEQ ID NO: 162 | HCDR3 (CHOTHIA) | DQGNWNYDDYYNGLDV |
| SEQ ID NO: 165 | HCDR1 (COMBINED) | GFTFNSCSMN |
| SEQ ID NO: 161 | HCDR2 (COMBINED) | YISSSSSTIYYADSVKG |
| SEQ ID NO: 162 | HCDR3 (COMBINED) | DQGNWNYDDYYNGLDV |
| SEQ ID NO: 166 | HCDR1 (IMGT) | GFTFNSCS |
| SEQ ID NO: 167 | HCDR2 (IMGT) | ISSSSSTI |
| SEQ ID NO: 168 | HCDR3 (IMGT) | ARDQGNWNYDDYYNGLDV |
| SEQ ID NO: 169 | VH | EVLLVESGGGLVQPGGSLRLSCAASGFTFNSCSMNW<br>VRQAPGKGLEWVSYISSSSSTIYYADSVKGRFTISRD<br>NAKNSLYLQMNSLKDEDTAVYYCARDQGNWNYDD<br>YYNGLDVWGQGTTVTVSS |
| SEQ ID NO: 170 | VH DNA | GAGGTGCTGCTGGTGGAGTCTGGGGGAGGCTTGGT<br>ACAGCCTGGGGGGTCCCTGAGACTCTCCTGTGCAG<br>CCTCTGGGTTCACCTTCAATAGCTGTAGCATGAAC<br>TGGGTCCGCCAGGCTCCAGGGAAGGGGCTGGAGT<br>GGGTTTCATACATTAGTAGTAGTAGTAGTACCATT<br>TACTACGCAGACTCTGTGAAGGGCCGATTCACCAT<br>CTCCAGAGACAATGCCAAGAACTCACTGTATCTGC<br>AAATGAACAGCCTGAAAGACGAGGACACGGCTGT<br>GTATTACTGTGCGAGAGATCAGGGTAACTGGAACT<br>ACGACGACTACTACAACGGTTTGGACGTCTGGGGC<br>CAAGGGACCACGGTCACCGTCTCCTCA |
| SEQ ID NO: 171 | HC | EVLLVESGGGLVQPGGSLRLSCAASGFTFNSCSMNW<br>VRQAPGKGLEWVSYISSSSSTIYYADSVKGRFTISRD<br>NAKNSLYLQMNSLKDEDTAVYYCARDQGNWNYDD<br>YYNGLDVWGQGTTVTVSSASTKGPSVFPLAPSSKST<br>SGGTAALGCLVKDYFPEPVTVSWNSGALTSGVHTFP<br>AVLQSSGLYSLSSVVTVPSSSLGTQTYICNVNHKPSN<br>TKVDKRVEPKSCDKTHTCPPCPAPELLGGPSVFLFPP<br>KPKDTLMISRTPEVTCVVVDVSHEDPEVKFNWYVDG<br>VEVHNAKTKPREEQYNSTYRVVSVLTVLHQDWLNG<br>KEYKCKVSNKALPAPIEKTISKAKGQPREPQVYTLPP<br>SREEMTKNQVSLTCLVKGFYPSDIAVEWESNGQPEN<br>NYKTTPPVLDSDGSFFLYSKLTVDKSRWQQGNVFSC<br>SVMHEALHNHYTQKSLSLSPGK |
| SEQ ID NO: 172 | HC DNA | GAGGTGCTGCTGGTGGAGTCTGGGGGAGGCTTGGT<br>ACAGCCTGGGGGGTCCCTGAGACTCTCCTGTGCAG<br>CCTCTGGGTTCACCTTCAATAGCTGTAGCATGAAC<br>TGGGTCCGCCAGGCTCCAGGGAAGGGGCTGGAGT<br>GGGTTTCATACATTAGTAGTAGTAGTAGTACCATT<br>TACTACGCAGACTCTGTGAAGGGCCGATTCACCAT<br>CTCCAGAGACAATGCCAAGAACTCACTGTATCTGC |

TABLE 1-continued

Sequences of Exemplary Monoclonal Antibodies (MAbs) and
Antibody Fragments (FABs) That Bind Human ENTPD2

| | | |
|---|---|---|
| | | AAATGAACAGCCTGAAAGACGAGGACACGGCTGT<br>GTATTACTGTGCGAGAGATCAGGGTAACTGGAACT<br>ACGACGACTACTACAACGGTTTGGACGTCTGGGGC<br>CAAGGGACCACGGTCACCGTCTCCTCAGCTAGCAC<br>CAAGGGCCCAAGTGTGTTTCCCCTGGCCCCCAGCA<br>GCAAGTCTACTTCCGGCGGAACTGCTGCCCTGGGT<br>TGCCTGGTGAAGGACTACTTCCCCGAGCCCGTGAC<br>AGTGTCCTGGAACTCTGGGGCTCTGACTTCCGGCG<br>TGCACACCTTCCCCGCCGTGCTGCAGAGCAGCGGC<br>CTGTACAGCCTGAGCAGCGTGGTGACAGTGCCCTC<br>CAGCTCTCTGGGAACCCAGACCTATATCTGCAACG<br>TGAACCACAAGCCCAGCAACACCAAGGTGGACAA<br>GAGAGTGGAGCCCAAGAGCTGCGACAAGACCCAC<br>ACCTGCCCCCCTGCCCAGCTCCAGAACTGCTGGG<br>AGGGCCTTCCGTGTTCCTGTTCCCCCCCAAGCCCA<br>AGGACACCCTGATGATCAGCAGGACCCCCGAGGT<br>GACCTGCGTGGTGGTGGACGTGTCCCACGAGGACC<br>CAGAGGTGAAGTTCAACTGGTACGTGGACGGCGT<br>GGAGGTGCACAACGCCAAGACCAAGCCCAGAGAG<br>GAGCAGTACAACAGCACCTACAGGGTGGTGTCCGT<br>GCTGACCGTGCTGCACCAGGACTGGCTGAACGGCA<br>AGGAATACAAGTGCAAAGTCTCCAACAAGGCCCT<br>GCCAGCCCCAATCGAAAAGACAATCAGCAAGGCC<br>AAGGGCCAGCCACGGGAGCCCCAGGTGTACACCC<br>TGCCCCCAGCCGGGAGGAGATGACCAAGAACCA<br>GGTGTCCCTGACCTGTCTGGTGAAGGGCTTCTACC<br>CCAGCGATATCGCCGTGGAGTGGGAGAGCAACGG<br>CCAGCCCGAGAACAACTACAAGACCACCCCCCCA<br>GTGCTGGACAGCGACGGCAGCTTCTTCCTGTACAG<br>CAAGCTGACCGTGGACAAGTCCAGGTGGCAGCAG<br>GGCAACGTGTTCAGCTGCAGCGTGATGCACGAGGC<br>CCTGCACAACCACTACACCCAGAAGTCCCTGAGCC<br>TGAGCCCCGGCAAG |
| SEQ ID NO: 173 | LCDR1 (KABAT) | RSSQSLLHSNGYNYLD |
| SEQ ID NO: 150 | LCDR2 (KABAT) | LGSNRAS |
| SEQ ID NO: 174 | LCDR3 (KABAT) | MQALQTPLT |
| SEQ ID NO: 175 | LCDR1 (CHOTHIA) | SQSLLHSNGYNY |
| SEQ ID NO: 153 | LCDR2 (CHOTHIA) | LGS |
| SEQ ID NO: 176 | LCDR3 (CHOTHIA) | ALQTPL |
| SEQ ID NO: 173 | LCDR1 (COMBINED) | RSSQSLLHSNGYNYLD |
| SEQ ID NO: 150 | LCDR2 (COMBINED) | LGSNRAS |
| SEQ ID NO: 174 | LCDR3 (COMBINED) | MQALQTPLT |
| SEQ ID NO: 177 | LCDR1 (IMGT) | QSLLHSNGYNY |
| SEQ ID NO: 153 | LCDR2 (IMGT) | LGS |
| SEQ ID NO: 174 | LCDR3 (IMGT) | MQALQTPLT |
| SEQ ID NO: 178 | VL | DIVMTQSPLSLPVTPGEPASISCRSSQSLLHSNGYNYL<br>DWYLQKPGQSPQLLIYLGSNRASGVPDRFSGSGSGT<br>DFTLKISRVEAEDVGVYYCMQALQTPLTFGGGTKVE<br>IK |
| SEQ ID NO: 179 | VL DNA | GATATTGTGATGACTCAGTCTCCACTCTCCCTGCCC<br>GTCACTCTTGGAGAGCCGGCCTCCATCTCCTGCAG<br>GTCTAGTCAGAGCCTCCTGCATAGTAATGGATACA<br>ACTATTTGGATTGGTACCTGCAGAAGCCAGGGCAG<br>TCTCCACAGCTCCTGATCTATTTGGGTTCTAATCGG<br>GCCTCCGGGGTCCCTGACAGGTTCAGTGGCAGTGG<br>ATCAGGCACAGATTTTACACTGAAAATCAGCAGAG<br>TGGAGGCTGAGGATGTTGGGGTTTATTACTGCATG<br>CAAGCTCTACAAACTCCTCACTTTCGGCGGAGGG<br>GACCAAGGTGGAGATCAAA |

TABLE 1-continued

Sequences of Exemplary Monoclonal Antibodies (MABs) and
Antibody Fragments (FABs) That Bind Human ENTPD2

| SEQ ID NO: 180 | LC | DIVMTQSPLSLPVTPGEPASISCRSSQSLLHSNGYNYL
DWYLQKPGQSPQLLIYLGSNRASGVPDRFSGSGSGT
DFTLKISRVEAEDVGVYYCMQALQTPLTFGGGTKVE
IKRTVAAPSVFIFPPSDEQLKSGTASVVCLLNNFYPRE
AKVQWKVDNALQSGNSQESVTEQDSKDSTYSLSSTL
TLSKADYEKHKVYACEVTHQGLSSPVTKSFNRGEC |
|---|---|---|
| SEQ ID NO: 181 | LC DNA | GATATTGTGATGACTCAGTCTCCACTCTCCCTGCCC
GTCACTCCTGGAGAGCCGGCCTCCATCTCCTGCAG
GTCTAGTCAGAGCCTCCTGCATAGTAATGGATACA
ACTATTTGGATTGGTACCTGCAGAAGCCAGGGCAG
TCTCCACAGCTCCTGATCTATTTGGGTTCTAATCGG
GCCTCCGGGGTCCCTGACAGGTTCAGTGGCAGTGG
ATCAGGCACAGATTTTACACTGAAAATCAGCAGAG
TGGAGGCTGAGGATGTTGGGGTTTATTACTGCATG
CAAGCTCTACAAACTCCTCTCACTTTCGGCGGAGG
GACCAAGGTGGAGATCAAACGTACGGTGGCCGCT
CCCAGCGTGTTCATCTTCCCCCCCAGCGACGAGCA
GCTGAAGAGTGGCACCGCCAGCGTGGTGTGCCTGC
TGAACAACTTCTACCCCCGGGAGGCCAAGGTGCAG
TGGAAGGTGGACAACGCCCTGCAGAGCGGCAACA
GCCAGGAGAGCGTCACCGAGCAGGACAGCAAGGA
CTCCACCTACAGCCTGAGCAGCACCCTGACCCTGA
GCAAGGCCGACTACGAGAAGCATAAGGTGTACGC
CTGCGAGGTGACCCACCAGGGCCTGTCCAGCCCCG
TGACCAAGAGCTTCAACAGGGGCGAGTGC |

ANTI-HUMAN
ENTPD2 MAB16

| SEQ ID NO: 37 | HCDR1 (KABAT) | SGYYWN |
|---|---|---|
| SEQ ID NO: 220 | HCDR2 (KABAT) | YISYDGDNNYNPSLKN |
| SEQ ID NO: 221 | HCDR3 (KABAT) | GYYRYGLSYYYVMDY |
| SEQ ID NO: 40 | HCDR1 (CHOTHIA) | GYSITSGY |
| SEQ ID NO: 222 | HCDR2 (CHOTHIA) | SYDGD |
| SEQ ID NO: 221 | HCDR3 (CHOTHIA) | GYYRYGLSYYYVMDY |
| SEQ ID NO: 42 | HCDR1 (COMBINED) | GYSITSGYYWN |
| SEQ ID NO: 220 | HCDR2 (COMBINED) | YISYDGDNNYNPSLKN |
| SEQ ID NO: 221 | HCDR3 (COMBINED) | GYYRYGLSYYYVMDY |
| SEQ ID NO: 43 | HCDR1 (IMGT) | GYSITSGYY |
| SEQ ID NO: 223 | HCDR2 (IMGT) | ISYDGDN |
| SEQ ID NO: 224 | HCDR3 (IMGT) | AGGYYRYGLSYYYVMDY |
| SEQ ID NO: 225 | VH | DIQLQESGPGLVKPSQSLSLTCSVTGYSITSGYYWNW
IRQFPGNKLEWMGYISYDGDNNYNPSLKNRISITRDT
SKNQFFLKLSSVTTEDTATYYCAGGYYRYGLSYYYV
MDYWGQGTSVTVSS |
| SEQ ID NO: 226 | VH DNA | GATATACAGCTTCAGGAGTCAGGACCTGGCCTCGT
GAAACCTTCTCAGTCTCTGTCTCTCACCTGCTCTGT
CACTGGCTACTCCATCACCAGTGGTTATTACTGGA
ACTGGATCCGGCAGTTTCCAGGAAACAAACTGGA
ATGGATGGGCTACATAAGCTACGACGGTGACAAT
AACTACAACCCATCTCTCAAAAATCGAATCTCCAT
CACTCGTGACACATCTAAGAACCAGTTTTTCCTGA
AGTTGAGTTCTGTGACTACTGAGGACACAGCTACA
TATTACTGTGCAGGAGGCTACTATAGGTACGGCCT
GTCGTATTACTATGTTATGGACTACTGGGGTCAAG
GAACCTCAGTCACCGTCTCCTCA |
| SEQ ID NO: 227 | HC | DIQLQESGPGLVKPSQSLSLTCSVTGYSITSGYYWNW
IRQFPGNKLEWMGYISYDGDNNYNPSLKNRISITRDT
SKNQFFLKLSSVTTEDTATYYCAGGYYRYGLSYYYV |

TABLE 1-continued

Sequences of Exemplary Monoclonal Antibodies (MABs) and
Antibody Fragments (FABs) That Bind Human ENTPD2

| | | |
|---|---|---|
| | | MDYWGQGTSVTVSSASTKGPSVFPLAPSSKSTSGGT AALGCLVKDYFPEPVTVSWNSGALTSGVHTFPAVLQ SSGLYSLSSVVTVPSSSLGTQTYICNVNHKPSNTKVD KRVEPKSCDKTHTCPPCPAPELLGGPSVFLFPPKPKD TLMISRTPEVTCVVVDVSHEDPEVKFNWYVDGVEV HNAKTKPREEQYNSTYRVVSVLTVLHQDWLNGKEY KCKVSNKALPAPIEKTISKAKGQPREPQVYTLPPSREE MTKNQVSLTCLVKGFYPSDIAVEWESNGQPENNYKT TPPVLDSDGSFFLYSKLTVDKSRWQQGNVFSCSVMH EALHNHYTQKSLSLSPGK |
| SEQ ID NO: 228 | HC DNA | GATATACAGCTTCAGGAGTCAGGACCTGGCCTCGT GAAACCTTCTCAGTCTCTGTCTCTCACCTGCTCTGT CACTGGCTACTCCATCACCAGTGGTTATTACTGGA ACTGGATCCGGCAGTTTCCAGGAAACAAACTGGA ATGGATGGGCTACATAAGCTACGACGGTGACAAT AACTACAACCCATCTCTCAAAAATCGAATCTCCAT CACTCGTGACACATCTAAGAACCAGTTTTTCCTGA AGTTGAGTTCTGTGACTACTGAGGACACAGCTACA TATTACTGTGCAGGAGGCTACTATAGGTACGGCCT GTCGTATTACTATGTTATGGACTACTGGGGTCAAG GAACCTCAGTCACCGTCTCCTCAGCTAGCACCAAG GGCCCAAGTGTGTTTCCCTGGCCCCAGCAGCAA GTCTACTTCCGGCGGAACTGCTGCCCTGGGTTGCC TGGTAAGGACTACTTCCCCGAGCCCGTGACAGTG TCCTGGAACTCTGGGGCTCTGACTTCCGGCGTGCA CACCTTCCCCGCCGTGCTGCAGAGCAGCGGCCTGT ACAGCCTGAGCAGCGTGGTGACAGTGCCCTCCAGC TCTCTGGGAACCCAGACCTATATCTGCAACGTGAA CCACAAGCCCAGCAACACCAAGGTGGACAAGAGA GTGGAGCCCAAGAGCTGCGACAAGACCCACACCT GCCCCCCTGCCCAGCTCCAGAACTGCTGGGAGGG CCTTCCGTGTTCCTGTTCCCCCCCAAGCCCAAGGA CACCCTGATGATCAGCAGGACCCCCGAGGTGACCT GCGTGGTGGTGGACGTGTCCCACGAGGACCCAGA GGTGAAGTTCAACTGGTACGTGGACGGCGTGGAG GTGCACAACGCCAAGACCAAGCCCAGAGAGGAGC AGTACAACAGCACCTACAGGGTGGTGTCCGTGCTG ACCGTGCTGCACCAGGACTGGCTGAACGGCAAAG AATACAAGTGCAAAGTCTCCAACAAGGCCCTGCCA GCCCCAATCGAAAAGACAATCAGCAAGGCCAAGG GCCAGCCACGGGAGCCCCAGGTGTACACCCTGCCC CCCAGCCGGGAGGAGATGACCAAGAACCAGGTGT CCCTGACCTGTCTGGTGAAGGGCTTCTACCCCAGC GATATCGCCGTGGAGTGGGAGAGCAACGGCCAGC CCGAGAACAACTACAAGACCACCCCCCCAGTGCTG GACAGCGACGGCAGCTTCTTCCTGTACAGCAAGCT GACCGTGGACAAGTCCAGGTGGCAGCAGGGCAAC GTGTTCAGCTGCAGCGTGATGCACGAGGCCCTGCA CAACCACTACACCCAGAAGTCCCTGAGCCTGAGCC CCGGCAAG |
| SEQ ID NO: 61 | LCDR1 (KABAT) | KASQSVDYDGNSYMN |
| SEQ ID NO: 51 | LCDR2 (KABAT) | AASNLES |
| SEQ ID NO: 52 | LCDR3 (KABAT) | QQSNEDPPT |
| SEQ ID NO: 62 | LCDR1 (CHOTHIA) | SQSVDYDGNSY |
| SEQ ID NO: 54 | LCDR2 (CHOTHIA) | AAS |
| SEQ ID NO: 55 | LCDR3 (CHOTHIA) | SNEDPP |
| SEQ ID NO: 61 | LCDR1 (COMBINED) | KASQSVDYDGNSYMN |
| SEQ ID NO: 51 | LCDR2 (COMBINED) | AASNLES |
| SEQ ID NO: 52 | LCDR3 (COMBINED) | QQSNEDPPT |
| SEQ ID NO: 63 | LCDR1 (IMGT) | QSVDYDGNSY |
| SEQ ID NO: 54 | LCDR2 (IMGT) | AAS |

TABLE 1-continued

Sequences of Exemplary Monoclonal Antibodies (MABs) and
Antibody Fragments (FABs) That Bind Human ENTPD2

| SEQ ID NO: 52 | LCDR3 (IMGT) | QQSNEDPPT |
|---|---|---|
| SEQ ID NO: 229 | VL | DTVLTQSPASLAVSLGQRATISCKASQSVDYDGNSY<br>MNWYQQKPGQPPKLLIYAASNLESGIPARFSGSGSGT<br>DFTLNIHPVEEEDAATYYCQQSNEDPPTFGGGTKLEI<br>K |
| SEQ ID NO: 230 | VL DNA | GACACTGTGCTGACCCAATCTCCAGCCTCTTTGGC<br>TGTGTCTCTAGGGCAGAGGGCCACCATCTCCTGCA<br>AGGCCAGCCAAAGTGTTGATTATGATGGTAATAGT<br>TATATGAACTGGTACCAACAGAAACCAGGACAGC<br>CACCCAAACTCCTCATCTATGCTGCATCCAATCTA<br>GAATCTGGGATCCCAGCCAGGTTTAGTGGCAGTGG<br>GTCTGGGACAGACTTCACCCTCAACATCCATCCTG<br>TGGAGGAGGAGGATGCTGCAACCTATTACTGTCAG<br>CAAAGTAATGAGGATCCTCCGACGTTCGGTGGAGG<br>CACCAAGCTGGAAATCAAA |
| SEQ ID NO: 231 | LC | DTVLTQSPASLAVSLGQRATISCKASQSVDYDGNSY<br>MNWYQQKPGQPPKLLIYAASNLESGIPARFSGSGSGT<br>DFTLNIHPVEEEDAATYYCQQSNEDPPTFGGGTKLEI<br>KRTVAAPSVFIFPPSDEQLKSGTASVVCLLNNFYPRE<br>AKVQWKVDNALQSGNSQESVTEQDSKDSTYSLSSTL<br>TLSKADYEKHKVYACEVTHQGLSSPVTKSFNRGEC |
| SEQ ID NO: 232 | LC DNA | GACACTGTGCTGACCCAATCTCCAGCCTCTTTGGC<br>TGTGTCTCTAGGGCAGAGGGCCACCATCTCCTGCA<br>AGGCCAGCCAAAGTGTTGATTATGATGGTAATAGT<br>TATATGAACTGGTACCAACAGAAACCAGGACAGC<br>CACCCAAACTCCTCATCTATGCTGCATCCAATCTA<br>GAATCTGGGATCCCAGCCAGGTTTAGTGGCAGTGG<br>GTCTGGGACAGACTTCACCCTCAACATCCATCCTG<br>TGGAGGAGGAGGATGCTGCAACCTATTACTGTCAG<br>CAAAGTAATGAGGATCCTCCGACGTTCGGTGGAGG<br>CACCAAGCTGGAAATCAAACGTACGGTGGCCGCTC<br>CCAGCGTGTTCATCTTCCCCCCCAGCGACGAGCAG<br>CTGAAGAGTGGCACCGCCAGCGTGGTGTGCCTGCT<br>GAACAACTTCTACCCCGGGAGGCCAAGGTGCAGT<br>GGAAGGTGGACAACGCCCTGCAGAGCGGCAACAG<br>CCAGGAGAGCGTCACCGAGCAGGACAGCAAGGAC<br>TCCACCTACAGCCTGAGCAGCACCCTGACCCTGAG<br>CAAGGCCGACTACGAGAAGCATAAGGTGTACGCC<br>TGCGAGGTGACCCACCAGGGCCTGTCCAGCCCCGT<br>GACCAAGAGCTTCAACAGGGGCGAGTGC |

| ANTI-HUMAN<br>ENTPD2 MAB17 | | |
|---|---|---|
| SEQ ID NO: 1 | HCDR1 (KABAT) | DYNMD |
| SEQ ID NO: 2 | HCDR2 (KABAT) | DINPKYDISTYNQQFKG |
| SEQ ID NO: 3 | HCDR3 (KABAT) | RGFFLYYGINYYYFDV |
| SEQ ID NO: 4 | HCDR1 (CHOTHIA) | GYTFTDY |
| SEQ ID NO: 5 | HCDR2 (CHOTHIA) | NPKYDI |
| SEQ ID NO: 3 | HCDR3 (CHOTHIA) | RGFFLYYGINYYYFDV |
| SEQ ID NO: 6 | HCDR1 (COMBINED) | GYTFTDYNMD |
| SEQ ID NO: 2 | HCDR2 (COMBINED) | DINPKYDISTYNQQFKG |
| SEQ ID NO: 3 | HCDR3 (COMBINED) | RGFFLYYGINYYYFDV |
| SEQ ID NO: 7 | HCDR1 (IMGT) | GYTFTDYN |
| SEQ ID NO: 8 | HCDR2 (IMGT) | INPKYDIS |
| SEQ ID NO: 9 | HCDR3 (IMGT) | ARRGFFLYYGINYYYFDV |
| SEQ ID NO: 233 | VH | EVQLQQFGAELVKPGASVKISCKASGYTFTDYNMD<br>WVKQSHGKSLEWIGDINPKYDISTYNQQFKGKATLT |

TABLE 1-continued

Sequences of Exemplary Monoclonal Antibodies (MABs) and
Antibody Fragments (FABs) That Bind Human ENTPD2

| | | |
|---|---|---|
| | | VDKSSSTAYMELRSLTSEDTAVYYCARRGFFLYYGI
NYYYFDVWGAGTTVTVSS |
| SEQ ID NO: 234 | VH DNA | GAGGTCCAACTGCAACAGTTTGGAGCTGAACTGGT
GAAGCCTGGGGCTTCAGTGAAGATATCCTGCAAGG
CTTCTGGCTACACATTCACTGACTACAACATGGAC
TGGGTGAAGCAGAGCCATGGAAAGAGCCTTGAGT
GGATTGGAGATATTAATCCTAAGTATGATATTTCT
ACCTACAATCAGCAATTCAAGGGAAAGGCCACATT
GACTGTAGACAAGTCCTCCAGCACAGCCTACATGG
AGCTCCGCAGCCTGACATCTGAGGACACTGCAGTC
TATTATTGTGCAAGAAGAGGCTTTTTTCTTTACTAC
GGTATTAACTACTATTACTTCGATGTCTGGGGCGC
AGGGACCACGGTCACCGTCTCCTCA |
| SEQ ID NO: 235 | HC | EVQLQQFGAELVKPGASVKISCKASGYTFTDYNMD
WVKQSHGKSLEWIGDINPKYDISTYNQQFKGKATLT
VDKSSSTAYMELRSLTSEDTAVYYCARRGFFLYYGI
NYYYFDVWGAGTTVTVSSASTKGPSVFPLAPSSKSTS
GGTAALGCLVKDYFPEPVTVSWNSGALTSGVHTFPA
VLQSSGLYSLSSVVTVPSSSLGTQTYICNVNHKPSNT
KVDKRVEPKSCDKTHTCPPCPAPELLGGPSVFLFPPK
PKDTLMISRTPEVTCVVVDVSHEDPEVKFNWYVDGV
EVHNAKTKPREEQYNSTYRVVSVLTVLHQDWLNGK
EYKCKVSNKALPAPIEKTISKAKGQPREPQVYTLPPS
REEMTKNQVSLTCLVKGFYPSDIAVEWESNGQPENN
YKTTPPVLDSDGSFFLYSKLTVDKSRWQQGNVFSCS
VMHEALHNHYTQKSLSLSPGK |
| SEQ ID NO: 236 | HC DNA | GAGGTCCAACTGCAACAGTTTGGAGCTGAACTGGT
GAAGCCTGGGGCTTCAGTGAAGATATCCTGCAAGG
CTTCTGGCTACACATTCACTGACTACAACATGGAC
TGGGTGAAGCAGAGCCATGGAAAGAGCCTTGAGT
GGATTGGAGATATTAATCCTAAGTATGATATTTCT
ACCTACAATCAGCAATTCAAGGGAAAGGCCACATT
GACTGTAGACAAGTCCTCCAGCACAGCCTACATGG
AGCTCCGCAGCCTGACATCTGAGGACACTGCAGTC
TATTATTGTGCAAGAAGAGGCTTTTTTCTTTACTAC
GGTATTAACTACTATTACTTCGATGTCTGGGGCGC
AGGGACCACGGTCACCGTCTCCTCAGCTAGCACCA
AGGGCCCAAGTGTGTTTCCCCTGGCCCCCAGCAGC
AAGTCTACTTCCGGCGGAACTGCTGCCCTGGGTTG
CCTGGTGAAGGACTACTTCCCCGAGCCCGTGACAG
TGTCCTGGAACTCTGGGGCTCTGACTTCCGGCGTG
CACACCTTCCCCGCCGTGCTGCAGAGCAGCGGCCT
GTACAGCCTGAGCAGCGTGGTGACAGTGCCCTCCA
GCTCTCTGGGAACCCAGACCTATATCTGCAACGTG
AACCACAAGCCCAGCAACACCAAGGTGGACAAGA
GAGTGGAGCCCAAGAGCTGCGACAAGACCCACAC
CTGCCCCCCCTGCCCAGCTCCAGAACTGCTGGGAG
GGCCTTCCGTGTTCCTGTTCCCCCCCAAGCCCAAG
GACACCCTGATGATCAGCAGGACCCCCGAGGTGA
CCTGCGTGGTGGTGGACGTGTCCCACGAGGACCCA
GAGGTGAAGTTCAACTGGTACGTGGACGGCGTGG
AGGTGCACAACGCCAAGACCAAGCCCAGAGAGGA
GCAGTACAACAGCACCTACAGGGTGGTGTCCGTGC
TGACCGTGCTGCACCAGGACTGGCTGAACGGCAA
AGAATACAAGTGCAAAGTCTCCAACAAGGCCCTG
CCAGCCCCAATCGAAAAGACAATCAGCAAGGCCA
AGGGCCAGCCACGGGAGCCCCAGGTGTACACCCT
GCCCCCCAGCCGGGAGGAGATGACCAAGAACCAG
GTGTCCCTGACCTGTCTGGTGAAGGGCTTCTACCC
CAGCGATATCGCCGTGGAGTGGGAGAGCAACGGC
CAGCCCGAGAACAACTACAAGACCACCCCCCCAG
TGCTGGACAGCGACGGCAGCTTCTTCCTGTACAGC
AAGCTGACCGTGGACAAGTCCAGGTGGCAGCAGG
GCAACGTGTTCAGCTGCAGCGTGATGCACGAGGCC
CTGCACAACCACTACACCCAGAAGTCCCTGAGCCT
GAGCCCCGGCAAG |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |

TABLE 1-continued

Sequences of Exemplary Monoclonal Antibodies (MAbs) and
Antibody Fragments (FABs) That Bind Human ENTPD2

| SEQ ID NO: 18 | LCDR2 (CHOTHIA) | STS |
|---|---|---|
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 237 | VL | QIVLTQSPAIMSASLGEEITLTCSASSSVSYIHWYQQK SGTSPTLLIYSTSNLASGVPSRFSGSGSGTFYSLTISSV EAEDAADYYCHQWSSYPWTFGGGTKLEIK |
| SEQ ID NO: 238 | VL DNA | CAAATTGTTCTCACCCAGTCTCCAGCAATCATGTCT GCATCTCTAGGGGAGGAGATCACCCTAACCTGCAG TGCCAGCTCGAGTGTAAGTTACATACACTGGTACC AGCAGAAGTCAGGCACTTCTCCCACACTCTTGATT TATAGCACATCCAATCTGGCTTCTGGAGTCCCTTCT CGCTTCAGTGGCAGTGGGTCTGGGACCTTTTATTCT CTCACAATCAGCAGTGTGGAGGCTGAAGATGCTGC CGATTATTACTGCCATCAGTGGAGTAGTTATCCAT GGACGTTCGGTGGAGGCACCAAGCTGGAAATCAA A |
| SEQ ID NO: 239 | LC | QIVLTQSPAIMSASLGEEITLTCSASSSVSYIHWYQQK SGTSPTLLIYSTSNLASGVPSRFSGSGSGTFYSLTISSV EAEDAADYYCHQWSSYPWTFGGGTKLEIKRTVAAP SVFIFPPSDEQLKSGTASVVCLLNNFYPREAKVQWKV DNALQSGNSQESVTEQDSKDSTYSLSSTLTLSKADYE KHKVYACEVTHQGLSSPVTKSFNRGEC |
| SEQ ID NO: 240 | LC DNA | CAAATTGTTCTCACCCAGTCTCCAGCAATCATGTCT GCATCTCTAGGGGAGGAGATCACCCTAACCTGCAG TGCCAGCTCGAGTGTAAGTTACATACACTGGTACC AGCAGAAGTCAGGCACTTCTCCCACACTCTTGATT TATAGCACATCCAATCTGGCTTCTGGAGTCCCTTCT CGCTTCAGTGGCAGTGGGTCTGGGACCTTTTATTCT CTCACAATCAGCAGTGTGGAGGCTGAAGATGCTGC CGATTATTACTGCCATCAGTGGAGTAGTTATCCAT GGACGTTCGGTGGAGGCACCAAGCTGGAAATCAA ACGTACGGTGGCCGCTCCCAGCGTGTTCATCTTCC CCCCAGCGACGAGCAGCTGAAGAGTGGCACCGC CAGCGTGGTGTGCCTGCTGAACAACTTCTACCCCC GGGAGGCCAAGGTGCAGTGGAAGGTGGACAACGC CCTGCAGAGCGGCAACAGCCAGGAGAGCGTCACC GAGCAGGACAGCAAGGACTCCACCTACAGCCTGA GCAGCACCCTGACCCTGAGCAAGGCCGACTACGA GAAGCATAAGGTGTACGCCTGCGAGGTGACCCAC CAGGGCCTGTCCAGCCCCGTGACCAAGAGCTTCAA CAGGGGCGAGTGC |

| ANTI-HUMAN ENTPD2 MAB18 | | |
|---|---|---|
| SEQ ID NO: 37 | HCDR1 (KABAT) | SGYYWN |
| SEQ ID NO: 220 | HCDR2 (KABAT) | YISYDGDNNYNPSLKN |
| SEQ ID NO: 68 | HCDR3 (KABAT) | GYYRYGLGSYSGSYYYVMDY |
| SEQ ID NO: 40 | HCDR1 (CHOTHIA) | GYSITSGY |
| SEQ ID NO: 222 | HCDR2 (CHOTHIA) | SYDGD |
| SEQ ID NO: 68 | HCDR3 (CHOTHIA) | GYYRYGLGSYSGSYYYVMDY |

TABLE 1-continued

Sequences of Exemplary Monoclonal Antibodies (MABs) and
Antibody Fragments (FABs) That Bind Human ENTPD2

| SEQ ID NO: 42 | HCDR1 (COMBINED) | GYSITSGYYWN |
|---|---|---|
| SEQ ID NO: 220 | HCDR2 (COMBINED) | YISYDGDNNYNPSLKN |
| SEQ ID NO: 68 | HCDR3 (COMBINED) | GYYRYGLGSYSGSYYYVMDY |
| SEQ ID NO: 43 | HCDR1 (IMGT) | GYSITSGYY |
| SEQ ID NO: 223 | HCDR2 (IMGT) | ISYDGDN |
| SEQ ID NO: 69 | HCDR3 (IMGT) | AGGYYRYGLGSYSGSYYYVMDY |
| SEQ ID NO: 241 | VH | DIQLQESGPGLVKPSQSLSLTCSVTGYSITSGYYWNW IRQFPGNKLEWMGYISYDGDNNYNPSLKNRISITRDT SKNQFFLKLSSVTTEDTATYYCAGGYYRYGLGSYSG SYYYVMDYWGQGTSVTVSS |
| SEQ ID NO: 242 | VH DNA | GATATACAGCTTCAGGAGTCAGGACCTGGCCTCGT GAAACCTTCTCAGTCTCTGTCTCTCACCTGCTCTGT CACTGGCTACTCCATCACCAGTGGTTATTACTGGA ACTGGATCCGGCAGTTTCCAGGAAACAAACTGGA ATGGATGGGCTACATAAGCTACGACGGTGACAAT AACTACAACCCATCTCTCAAAAATCGAATCTCCAT CACTCGTGACACATCTAAGAACCAGTTTTTCCTGA AGTTGAGTTCTGTGACTACTGAGGACACAGCTACA TATTACTGTGCAGGAGGCTACTATAGGTACGGCCT GGGCTCCTACTCCGGCTCGTATTACTATGTTATGG ACTACTGGGGTCAAGGAACCTCAGTCACCGTCTCC TCA |
| SEQ ID NO: 243 | HC | DIQLQESGPGLVKPSQSLSLTCSVTGYSITSGYYWNW IRQFPGNKLEWMGYISYDGDNNYNPSLKNRISITRDT SKNQFFLKLSSVTTEDTATYYCAGGYYRYGLGSYSG SYYYVMDYWGQGTSVTVSSASTKGPSVFPLAPSSKS TSGGTAALGCLVKDYFPEPVTVSWNSGALTSGVHTF PAVLQSSGLYSLSSVVTVPSSSLGTQTYICNVNHKPS NTKVDKRVEPKSCDKTHTCPPCPAPELLGGPSVFLFP PKPKDTLMISRTPEVTCVVVDVSHEDPEVKFNWYVD GVEVHNAKTKPREEQYNSTYRVVSVLTVLHQDWLN GKEYKCKVSNKALPAPIEKTISKAKGQPREPQVYTLP PSREEMTKNQVSLTCLVKGFYPSDIAVEWESNGQPE NNYKTTPPVLDSDGSFFLYSKLTVDKSRWQQGNVFS CSVMHEALHNHYTQKSLSLSPGK |
| SEQ ID NO: 244 | HC DNA | GATATACAGCTTCAGGAGTCAGGACCTGGCCTCGT GAAACCTTCTCAGTCTCTGTCTCTCACCTGCTCTGT CACTGGCTACTCCATCACCAGTGGTTATTACTGGA ACTGGATCCGGCAGTTTCCAGGAAACAAACTGGA ATGGATGGGCTACATAAGCTACGACGGTGACAAT AACTACAACCCATCTCTCAAAAATCGAATCTCCAT CACTCGTGACACATCTAAGAACCAGTTTTTCCTGA AGTTGAGTTCTGTGACTACTGAGGACACAGCTACA TATTACTGTGCAGGAGGCTACTATAGGTACGGCCT GGGCTCCTACTCCGGCTCGTATTACTATGTTATGG ACTACTGGGGTCAAGGAACCTCAGTCACCGTCTCC TCAGCTAGCACCAAGGGCCCAAGTGTGTTTCCCCT GGCCCCCAGCAGCAAGTCTACTTCCGGCGGAACTG CTGCCCTGGGTTGCCTGGTGAAGGACTACTTCCCC GAGCCCGTGACAGTGTCCTGGAACTCTGGGGCTCT GACTTCCGGCGTGCACACCTTCCCCGCCGTGCTGC AGAGCAGCGGCCTGTACAGCCTGAGCAGCGTGGT GACAGTGCCCTCCAGCTCTCTGGGAACCCAGACCT ATATCTGCAACGTGAACCACAAGCCCAGCAACACC AAGGTGGACAAGAGAGTGGAGCCCAAGAGCTGCG ACAAGACCCACACCTGCCCCCCCTGCCCAGCTCCA GAACTGCTGGGAGGGCCTTCCGTGTTCCTGTTCCC CCCCAAGCCCAAGGACACCCTGATGATCAGCAGG ACCCCCGAGGTGACCTGCTGGTGGTGGACGTGTC CCACGAGGACCCAGAGGTGAAGTTCAACTGGTAC GTGGACGGCGTGGAGGTGCACAACGCCAAGACCA AGCCCAGAGAGGAGCAGTACAACAGCACCTACAG GGTGGTGTCCGTGCTGACCGTGCTGCACCAGGACT GGCTGAACGGCAAAGAATACAAGTGCAAAGTCTC CAACAAGGCCCTGCCAGCCCCAATCGAAAAGACA |

TABLE 1-continued

Sequences of Exemplary Monoclonal Antibodies (MABs) and
Antibody Fragments (FABs) That Bind Human ENTPD2

| | | |
|---|---|---|
| | | ATCAGCAAGGCCAAGGGCCAGCCACGGGAGCCCC<br>AGGTGTACACCCTGCCCCCAGCCGGGAGGAGAT<br>GACCAAGAACCAGGTGTCCCTGACCTGTCTGGTGA<br>AGGGCTTCTACCCCAGCGATATCGCCGTGGAGTGG<br>GAGAGCAACGGCCAGCCCGAGAACAACTACAAGA<br>CCACCCCCCCAGTGCTGGACAGCGACGGCAGCTTC<br>TTCCTGTACAGCAAGCTGACCGTGGACAAGTCCAG<br>GTGGCAGCAGGGCAACGTGTTCAGCTGCAGCGTG<br>ATGCACGAGGCCCTGCACAACCACTACACCCAGA<br>AGTCCCTGAGCCTGAGCCCCGGCAAG |
| SEQ ID NO: 61 | LCDR1 (KABAT) | KASQSVDYDGNSYMN |
| SEQ ID NO: 51 | LCDR2 (KABAT) | AASNLES |
| SEQ ID NO: 52 | LCDR3 (KABAT) | QQSNEDPPT |
| SEQ ID NO: 62 | LCDR1 (CHOTHIA) | SQSVDYDGNSY |
| SEQ ID NO: 54 | LCDR2 (CHOTHIA) | AAS |
| SEQ ID NO: 55 | LCDR3 (CHOTHIA) | SNEDPP |
| SEQ ID NO: 61 | LCDR1 (COMBINED) | KASQSVDYDGNSYMN |
| SEQ ID NO: 51 | LCDR2 (COMBINED) | AASNLES |
| SEQ ID NO: 52 | LCDR3 (COMBINED) | QQSNEDPPT |
| SEQ ID NO: 63 | LCDR1 (IMGT) | QSVDYDGNSY |
| SEQ ID NO: 54 | LCDR2 (IMGT) | AAS |
| SEQ ID NO: 52 | LCDR3 (IMGT) | QQSNEDPPT |
| SEQ ID NO: 229 | VL | DTVLTQSPASLAVSLGQRATISCKASQSVDYDGNSY<br>MNWYQQKPGQPPKLLIYAASNLESGIPARFSGSGSGT<br>DFTLNIHPVEEEDAATYYCQQSNEDPPTFGGGTKLEI<br>K |
| SEQ ID NO: 230 | VL DNA | GACACTGTGCTGACCCAATCTCCAGCCTCTTTGGC<br>TGTGTCTCTAGGGCAGAGGGCCACCATCTCCTGCA<br>AGGCCAGCCAAAGTGTTGATTATGATGGTAATAGT<br>TATATGAACTGGTACCAACAGAAACCAGGACAGC<br>CACCCAAACTCCTCATCTATGCTGCATCCAATCTA<br>GAATCTGGGATCCCAGCCAGGTTTAGTGGCAGTGG<br>GTCTGGGACAGACTTCACCCTCAACATCCATCCTG<br>TGGAGGAGGAGGATGCTGCAACCTATTACTGTCAG<br>CAAAGTAATGAGGATCCTCCGACGTTCGGTGGAGG<br>CACCAAGCTGGAAATCAAA |
| SEQ ID NO: 231 | LC | DTVLTQSPASLAVSLGQRATISCKASQSVDYDGNSY<br>MNWYQQKPGQPPKLLIYAASNLESGIPARFSGSGSGT<br>DFTLNIHPVEEEDAATYYCQQSNEDPPTFGGGTKLEI<br>KRTVAAPSVFIFPPSDEQLKSGTASVVCLLNNFYPRE<br>AKVQWKVDNALQSGNSQESVTEQDSKDSTYSLSSTL<br>TLSKADYEKHKVYACEVTHQGLSSPVTKSFNRGEC |
| SEQ ID NO: 232 | LC DNA | GACACTGTGCTGACCCAATCTCCAGCCTCTTTGGC<br>TGTGTCTCTAGGGCAGAGGGCCACCATCTCCTGCA<br>AGGCCAGCCAAAGTGTTGATTATGATGGTAATAGT<br>TATATGAACTGGTACCAACAGAAACCAGGACAGC<br>CACCCAAACTCCTCATCTATGCTGCATCCAATCTA<br>GAATCTGGGATCCCAGCCAGGTTTAGTGGCAGTGG<br>GTCTGGGACAGACTTCACCCTCAACATCCATCCTG<br>TGGAGGAGGAGGATGCTGCAACCTATTACTGTCAG<br>CAAAGTAATGAGGATCCTCCGACGTTCGGTGGAGG<br>CACCAAGCTGGAAATCAAACGTACGGTGGCCGCTC<br>CCAGCGTGTTCATCTTCCCCCCAGCGACGAGCAG<br>CTGAAGAGTGGCACCGCCAGCGTGGTGTGCCTGCT<br>GAACAACTTCTACCCCGGGAGGCCAAGGTGCAGT<br>GGAAGGTGGACAACGCCCTGCAGAGCGGCAACAG<br>CCAGGAGAGCGTCACCGAGCAGGACAGCAAGGAC<br>TCCACCTACAGCCTGAGCAGCACCCTGACCCTGAG |

TABLE 1-continued

Sequences of Exemplary Monoclonal Antibodies (MABs) and
Antibody Fragments (FABs) That Bind Human ENTPD2

|  |  |  |
|---|---|---|
|  |  | CAAGGCCGACTACGAGAAGCATAAGGTGTACGCC<br>TGCGAGGTGACCCACCAGGGCCTGTCCAGCCCCGT<br>GACCAAGAGCTTCAACAGGGGCGAGTGC |
| ANTI-HUMAN<br>ENTPD2 MAB19 |  |  |
| SEQ ID NO: 1 | HCDR1 (KABAT) | DYNMD |
| SEQ ID NO: 245 | HCDR2 (KABAT) | DINPNYDITTYNQRFKG |
| SEQ ID NO: 246 | HCDR3 (KABAT) | RGFFPYYGNSYYYFDV |
| SEQ ID NO: 4 | HCDR1 (CHOTHIA) | GYTFTDY |
| SEQ ID NO: 247 | HCDR2 (CHOTHIA) | NPNYDI |
| SEQ ID NO: 246 | HCDR3 (CHOTHIA) | RGFFPYYGNSYYYFDV |
| SEQ ID NO: 6 | HCDR1 (COMBINED) | GYTFTDYNMD |
| SEQ ID NO: 245 | HCDR2 (COMBINED) | DINPNYDITTYNQRFKG |
| SEQ ID NO: 246 | HCDR3 (COMBINED) | RGFFPYYGNSYYYFDV |
| SEQ ID NO: 7 | HCDR1 (IMGT) | GYTFTDYN |
| SEQ ID NO: 248 | HCDR2 (IMGT) | INPNYDIT |
| SEQ ID NO: 249 | HCDR3 (IMGT) | ARRGFFPYYGNSYYYFDV |
| SEQ ID NO: 250 | VH | EVQLQQFGAELVKPGTSVKISCKASGYTFTDYNMD<br>WVKQSHGKSLEWIGDINPNYDITTYNQRFKGKATLT<br>VDKSSSTAYMELRSLTSEDTAVYYCARRGFFPYYGN<br>SYYYFDVWGAGTTVTVSS |
| SEQ ID NO: 251 | VH DNA | GAGGTCCAGCTGCAACAGTTTGGAGCTGAGCTGGT<br>GAAGCCTGGGACTTCAGTGAAGATATCCTGCAAGG<br>CTTCTGGCTACACATTCACTGACTACAACATGGAC<br>TGGGTGAAGCAGAGCCATGGAAAGAGCCTTGAGT<br>GGATTGGAGATATTAATCCTAACTATGATATTACT<br>ACCTACAACCAGAGGTTCAAGGGAAAGGCCACAT<br>TGACTGTAGACAAGTCCTCCAGCACAGCCTACATG<br>GAGCTCCGCAGCCTGACATCTGAGGACACTGCAGT<br>CTATTACTGTGCAAGAAGAGGATTTTTTCCTTATTA<br>CGGTAATAGCTACTATTACTTCGATGTCTGGGGCG<br>CAGGGACCACGGTCACCGTCTCCTCA |
| SEQ ID NO: 252 | HC | EVQLQQFGAELVKPGTSVKISCKASGYTFTDYNMD<br>WVKQSHGKSLEWIGDINPNYDITTYNQRFKGKATLT<br>VDKSSSTAYMELRSLTSEDTAVYYCARRGFFPYYGN<br>SYYYFDVWGAGTTVTVSSASTKGPSVFPLAPSSKSTS<br>GGTAALGCLVKDYFPEPVTVSWNSGALTSGVHTFPA<br>VLQSSGLYSLSSVVTVPSSSLGTQTYICNVNHKPSNT<br>KVDKRVEPKSCDKTHTCPPCPAPELLGGPSVFLFPPK<br>PKDTLMISRTPEVTCVVVDVSHEDPEVKFNWYVDGV<br>EVHNAKTKPREEQYNSTYRVVSVLTVLHQDWLNGK<br>EYKCKVSNKALPAPIEKTISKAKGQPREPQVYTLPPS<br>REEMTKNQVSLTCLVKGFYPSDIAVEWESNGQPENN<br>YKTTPPVLDSDGSFFLYSKLTVDKSRWQQGNVFSCS<br>VMHEALHNHYTQKSLSLSPGK |
| SEQ ID NO: 253 | HC DNA | GAGGTCCAGCTGCAACAGTTTGGAGCTGAGCTGGT<br>GAAGCCTGGGACTTCAGTGAAGATATCCTGCAAGG<br>CTTCTGGCTACACATTCACTGACTACAACATGGAC<br>TGGGTGAAGCAGAGCCATGGAAAGAGCCTTGAGT<br>GGATTGGAGATATTAATCCTAACTATGATATTACT<br>ACCTACAACCAGAGGTTCAAGGGAAAGGCCACAT<br>TGACTGTAGACAAGTCCTCCAGCACAGCCTACATG<br>GAGCTCCGCAGCCTGACATCTGAGGACACTGCAGT<br>CTATTACTGTGCAAGAAGAGGATTTTTTCCTTATTA<br>CGGTAATAGCTACTATTACTTCGATGTCTGGGGCG<br>CAGGGACCACGGTCACCGTCTCCTCAGCTAGCACC<br>AAGGGCCCAAGTGTGTTTCCCCTGGCCCCCAGCAG |

TABLE 1-continued

Sequences of Exemplary Monoclonal Antibodies (MABs) and
Antibody Fragments (FABs) That Bind Human ENTPD2

```
                              CAAGTCTACTTCCGGCGGAACTGCTGCCCTGGGTT
                              GCCTGGTGAAGGACTACTTCCCCGAGCCCGTGACA
                              GTGTCCTGGAACTCTGGGGCTCTGACTTCCGGCGT
                              GCACACCTTCCCCGCCGTGCTGCAGAGCAGCGGCC
                              TGTACAGCCTGAGCAGCGTGGTGACAGTGCCCTCC
                              AGCTCTCTGGGAACCCAGACCTATATCTGCAACGT
                              GAACCACAAGCCCAGCAACACCAAGGTGGACAAG
                              AGAGTGGAGCCCAAGAGCTGCGACAAGACCCACA
                              CCTGCCCCCCCTGCCCAGCTCCAGAACTGCTGGGA
                              GGGCCTTCCGTGTTCCTGTTCCCCCCCAAGCCCAA
                              GGACACCCTGATGATCAGCAGGACCCCCGAGGTG
                              ACCTGCGTGGTGGTGGACGTGTCCCACGAGGACCC
                              AGAGGTGAAGTTCAACTGGTACGTGGACGGCGTG
                              GAGGTGCACAACGCCAAGACCAAGCCCAGAGAGG
                              AGCAGTACAACAGCACCTACAGGGTGGTGTCCGTG
                              CTGACCGTGCTGCACCAGGACTGGCTGAACGGCAA
                              AGAATACAAGTGCAAAGTCTCCAACAAGGCCCTG
                              CCAGCCCCAATCGAAAAGACAATCAGCAAGGCCA
                              AGGGCCAGCCACGGGAGCCCCAGGTGTACACCCT
                              GCCCCCCAGCCGGGAGGAGATGACCAAGAACCAG
                              GTGTCCCTGACCTGTCTGGTGAAGGGCTTCTACCC
                              CAGCGATATCGCCGTGGAGTGGGAGAGCAACGGC
                              CAGCCCGAGAACAACTACAAGACCACCCCCCCCAG
                              TGCTGGACAGCGACGGCAGCTTCTTCCTGTACAGC
                              AAGCTGACCGTGGACAAGTCCAGGTGGCAGCAGG
                              GCAACGTGTTCAGCTGCAGCGTGATGCACGAGGCC
                              CTGCACAACCACTACACCCAGAAGTCCCTGAGCCT
                              GAGCCCCGGCAAG
```

| SEQ ID NO: 254 | LCDR1 (KABAT) | SASSSVSYMH |
| --- | --- | --- |
| SEQ ID NO: 15 | LCDR2 (KABAT) | STSNLAS |
| SEQ ID NO: 255 | LCDR3 (KABAT) | HQWSNYPWT |
| SEQ ID NO: 17 | LCDR1 (CHOTHIA) | SSSVSY |
| SEQ ID NO: 18 | LCDR2 (CHOTHIA) | STS |
| SEQ ID NO: 256 | LCDR3 (CHOTHIA) | WSNYPW |
| SEQ ID NO: 254 | LCDR1 (COMBINED) | SASSSVSYMH |
| SEQ ID NO: 15 | LCDR2 (COMBINED) | STSNLAS |
| SEQ ID NO: 255 | LCDR3 (COMBINED) | HQWSNYPWT |
| SEQ ID NO: 20 | LCDR1 (IMGT) | SSVSY |
| SEQ ID NO: 18 | LCDR2 (IMGT) | STS |
| SEQ ID NO: 255 | LCDR3 (IMGT) | HQWSNYPWT |
| SEQ ID NO: 257 | VL | QIVLTQSPTIMSASLGEEITLTCSASSSVSYMHWYQQ KSGTSPKLLIYSTSNLASGVPSRFSGSGSGTFYSLTISS VEAEDAADYYCHQWSNYPWTFGGGTKLEIK |
| SEQ ID NO: 258 | VL DNA | CAAATTGTTCTCACCCAGTCTCCAACAATCATGTCT GCATCTCTAGGGGAGGAGATCACCCTTACCTGCAG TGCCAGCTCGAGTGTAAGTTACATGCACTGGTACC AGCAGAAGTCAGGCACTTCTCCCAAACTCTTGATT TATAGCACATCCAACCTGGCTTCTGGAGTCCCTTCT CGCTTCAGTGGCAGTGGGTCTGGGACCTTTTATTCT CTCACAATCAGCAGTGTGGAGGCTGAAGATGCTGC CGATTATTACTGCCATCAGTGGAGTAATTATCCAT GGACGTTCGGTGGAGGCACCAAGCTGGAAATCAA A |
| SEQ ID NO: 259 | LC | QIVLTQSPTIMSASLGEEITLTCSASSSVSYMHWYQQ KSGTSPKLLIYSTSNLASGVPSRFSGSGSGTFYSLTISS VEAEDAADYYCHQWSNYPWTFGGGTKLEIKRTVAA PSVFIFPPSDEQLKSGTASVVCLLNNFYPREAKVQWK VDNALQSGNSQESVTEQDSKDSTYSLSSTLTLSKADY EKHKVYACEVTHQGLSSPVTKSFNRGEC |

TABLE 1-continued

Sequences of Exemplary Monoclonal Antibodies (MABs) and
Antibody Fragments (FABs) That Bind Human ENTPD2

| SEQ ID NO: 260 | LC DNA | CAAATTGTTCTCACCCAGTCTCCAACAATCATGTCT
GCATCTCTAGGGGAGGAGATCACCCTTACCTGCAG
TGCCAGCTCGAGTGTAAGTTACATGCACTGGTACC
AGCAGAAGTCAGGCACTTCTCCCAAACTCTTGATT
TATAGCACATCCAACCTGGCTTCTGGAGTCCCTTCT
CGCTTCAGTGGCAGTGGGTCTGGGACCTTTTATTCT
CTCACAATCAGCAGTGTGGAGGCTGAAGATGCTGC
CGATTATTACTGCCATCAGTGGAGTAATTATCCAT
GGACGTTCGGTGGAGGCACCAAGCTGGAAATCAA
ACGTACGGTGGCCGCTCCCAGCGTGTTCATCTTCC
CCCCAGCGACGAGCAGCTGAAGAGTGGCACCGC
CAGCGTGGTGTGCCTGCTGAACAACTTCTACCCCC
GGGAGGCCAAGGTGCAGTGGAAGGTGGACAACGC
CCTGCAGAGCGGCAACAGCCAGGAGAGCGTCACC
GAGCAGGACAGCAAGGACTCCACCTACAGCCTGA
GCAGCACCCTGACCCTGAGCAAGGCCGACTACGA
GAAGCATAAGGTGTACGCCTGCGAGGTGACCCAC
CAGGGCCTGTCCAGCCCCGTGACCAAGAGCTTCAA
CAGGGGCGAGTGC |

ANTI-HUMAN
ENTPD2 MAB20

| SEQ ID NO: 1 | HCDR1 (KABAT) | DYNMD |
| SEQ ID NO: 261 | HCDR2 (KABAT) | DINPNYDITSYNQKFKG |
| SEQ ID NO: 262 | HCDR3 (KABAT) | RGFFLYYGSSYYYFDV |
| SEQ ID NO: 4 | HCDR1 (CHOTHIA) | GYTFTDY |
| SEQ ID NO: 247 | HCDR2 (CHOTHIA) | NPNYDI |
| SEQ ID NO: 262 | HCDR3 (CHOTHIA) | RGFFLYYGSSYYYFDV |
| SEQ ID NO: 6 | HCDR1 (COMBINED) | GYTFTDYNMD |
| SEQ ID NO: 261 | HCDR2 (COMBINED) | DINPNYDITSYNQKFKG |
| SEQ ID NO: 262 | HCDR3 (COMBINED) | RGFFLYYGSSYYYFDV |
| SEQ ID NO: 7 | HCDR1 (IMGT) | GYTFTDYN |
| SEQ ID NO: 248 | HCDR2 (IMGT) | INPNYDIT |
| SEQ ID NO: 263 | HCDR3 (IMGT) | ARRGFFLYYGSSYYYFDV |
| SEQ ID NO: 264 | VH | EVQLQQFGAELVKPGASVKISCKASGYTFTDYNMD
WVKQSHGKSLEWIGDINPNYDITSYNQKFKGKATLT
VDKSSSTAYMELRSLTSEDTAVYYCARRGFFLYYGS
SYYYFDVWGAGTTVTVSS |
| SEQ ID NO: 265 | VH DNA | GAGGTCCAGCTGCAACAGTTTGGAGCTGAGCTGGT
GAAGCCTGGGGCTTCAGTGAAGATATCCTGCAAGG
CTTCTGGCTACACATTCACTGACTACAACATGGAC
TGGGTGAAGCAGAGCCATGGAAAGAGCCTTGAGT
GGATTGGAGATATTAATCCTAACTATGATATTACT
AGCTACAACCAGAAGTTCAAGGGAAAGGCCACAT
TGACTGTAGACAAGTCCTCCAGCACAGCCTACATG
GAGCTCCGCAGCCTGACATCTGAGGACACTGCAGT
CTATTACTGTGCAAGAAGGGTTTTTTCTTTACTA
CGGTAGTAGCTACTATTACTTCGATGTCTGGGGCG
CAGGGACCACGGTCACCGTCTCCTCA |
| SEQ ID NO: 266 | HC | EVQLQQFGAELVKPGASVKISCKASGYTFTDYNMD
WVKQSHGKSLEWIGDINPNYDITSYNQKFKGKATLT
VDKSSSTAYMELRSLTSEDTAVYYCARRGFFLYYGS
SYYYFDVWGAGTTVTVSSASTKGPSVFPLAPSSKSTS
GGTAALGCLVKDYFPEPVTVSWNSGALTSGVHTFPA
VLQSSGLYSLSSVVTVPSSSLGTQTYICNVNHKPSNT
KVDKRVEPKSCDKTHTCPPCPAPELLGGPSVFLFPPK
PKDTLMISRTPEVTCVVVDVSHEDPEVKFNWYVDGV
EVHNAKTKPREEQYNSTYRVVSVLTVLHQDWLNGK |

TABLE 1-continued

Sequences of Exemplary Monoclonal Antibodies (MABs) and Antibody Fragments (FABs) That Bind Human ENTPD2

| | | |
|---|---|---|
| | | EYKCKVSNKALPAPIEKTISKAKGQPREPQVYTLPPS REEMTKNQVSLTCLVKGFYPSDIAVEWESNGQPENN YKTTPPVLDSDGSFFLYSKLTVDKSRWQQGNVFSCS VMHEALHNHYTQKSLSLSPGK |
| SEQ ID NO: 267 | HC DNA | GAGGTCCAGCTGCAACAGTTTGGAGCTGAGCTGGT GAAGCCTGGGGCTTCAGTGAAGATATCCTGCAAGG CTTCTGGCTACACATTCACTGACTACAACATGGAC TGGGTGAAGCAGAGCCATGGAAAGAGCCTTGAGT GGATTGGAGATATTAATCCTAACTATGATATTACT AGCTACAACCAGAAGTTCAAGGGAAAGGCCACAT TGACTGTAGACAAGTCCTCCAGCACAGCCTACATG GAGCTCCGCAGCCTGACATCTGAGGACACTGCAGT CTATTACTGTGCAAGAAGAGGGTTTTTTCTTTACTA CGGTAGTAGCTACTATTACTTCGATGTCTGGGGCG CAGGGACCACGGTCACCGTCTCCTCAGCTAGCACC AAGGGCCCAAGTGTGTTTCCCCTGGCCCCCAGCAG CAAGTCTACTTCCGGCGGAACTGCTGCCCTGGGTT GCCTGGTGAAGGACTACTTCCCCGAGCCCGTGACA GTGTCCTGGAACTCTGGGGCTCTGACTTCCGGCGT GCACACCTTCCCCGCCGTGCTGCAGAGCAGCGGCC TGTACAGCCTGAGCAGCGTGGTGACAGTGCCCTCC AGCTCTCTGGGAACCCAGACCTATATCTGCAACGT GAACCACAAGCCCAGCAACACCAAGGTGGACAAG AGAGTGGAGCCCAAGAGCTGCGACAAGACCCACA CCTGCCCCCCCTGCCCAGCTCCAGAACTGCTGGGA GGGCCTTCCGTGTTCCTGTTCCCCCCCAAGCCCAA GGACACCCTGATGATCAGCAGGACCCCCGAGGTG ACCTGCGTGGTGGTGGACGTGTCCCACGAGGACCC AGAGGTGAAGTTCAACTGGTACGTGGACGGCGTG GAGGTGCACAACGCCAAGACCAAGCCCAGAGAGG AGCAGTACAACAGCACCTACAGGGTGGTGTCCGTG CTGACCGTGCTGCACCAGGACTGGCTGAACGGCAA AGAATACAAGTGCAAAGTCTCCAACAAGGCCCTG CCAGCCCCAATCGAAAAGACAATCAGCAAGGCCA AGGGCCAGCCACGGGAGCCCCAGGTGTACACCCT GCCCCCCAGCCGGGAGGAGATGACCAAGAACCAG GTGTCCCTGACCTGTCTGGTGAAGGGCTTCTACCC CAGCGATATCGCCGTGGAGTGGGAGAGCAACGGC CAGCCCGAGAACAACTACAAGACCACCCCCCCCAG TGCTGGACAGCGACGGCAGCTTCTTCCTGTACAGC AAGCTGACCGTGGACAAGTCCAGGTGGCAGCAGG GCAACGTGTTCAGCTGCAGCGTGATGCACGAGGCC CTGCACAACCACTACACCCAGAAGTCCCTGAGCCT GAGCCCCGGCAAG |
| SEQ ID NO: 254 | LCDR1 (KABAT) | SASSSVSYMH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 18 | LCDR2 (CHOTHIA) | STS |
| SEQ ID NO: 19 | LCDR3 (CHOTHIA) | WSSYPW |
| SEQ ID NO: 254 | LCDR1 (COMBINED) | SASSSVSYMH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 268 | VL | QIVLTQSPAIMSASLGEEITLTCSASSSVSYMHWYQQ KSGTSPKLLIYSTSNLASGVPSRFSGSGSGTFYSLTISS VEAEDAADYYCHQWSSYPWTFGGGTKLEIK |

TABLE 1-continued

Sequences of Exemplary Monoclonal Antibodies (MABs) and
Antibody Fragments (FABs) That Bind Human ENTPD2

| SEQ ID NO: 269 | VL DNA | CAAATTGTTCTCACCCAGTCTCCAGCAATCATGTCT
GCATCTCTAGGGGAGGAGATCACCCTAACCTGCAG
TGCCAGCTCGAGTGTAAGTTACATGCACTGGTACC
AGCAGAAGTCAGGCACTTCTCCCAAACTCTTGATT
TATAGCACATCCAACCTGGCTTCTGGAGTCCCTTCT
CGCTTCAGTGGCAGTGGGTCTGGGACCTTTTATTCT
CTCACAATCAGCAGTGTGGAGGCTGAAGATGCTGC
CGATTATTACTGCCATCAGTGGAGTAGTTATCCAT
GGACGTTCGGTGGAGGCACCAAGCTGGAAATCAA
A |
| SEQ ID NO: 270 | LC | QIVLTQSPAIMSASLGEEITLTCSASSSVSYMHWYQQ
KSGTSPKLLIYSTSNLASGVPSRFSGSGSGTFYSLTISS
VEAEDAADYYCHQWSSYPWTFGGGTKLEIKRTVAA
PSVFIFPPSDEQLKSGTASVVCLLNNFYPREAKVQWK
VDNALQSGNSQESVTEQDSKDSTYSLSSTLTLSKADY
EKHKVYACEVTHQGLSSPVTKSFNRGEC |
| SEQ ID NO: 271 | LC DNA | CAAATTGTTCTCACCCAGTCTCCAGCAATCATGTCT
GCATCTCTAGGGGAGGAGATCACCCTAACCTGCAG
TGCCAGCTCGAGTGTAAGTTACATGCACTGGTACC
AGCAGAAGTCAGGCACTTCTCCCAAACTCTTGATT
TATAGCACATCCAACCTGGCTTCTGGAGTCCCTTCT
CGCTTCAGTGGCAGTGGGTCTGGGACCTTTTATTCT
CTCACAATCAGCAGTGTGGAGGCTGAAGATGCTGC
CGATTATTACTGCCATCAGTGGAGTAGTTATCCAT
GGACGTTCGGTGGAGGCACCAAGCTGGAAATCAA
ACGTACGGTGGCCGCTCCCAGCGTGTTCATCTTCC
CCCCCAGCGACGAGCAGCTGAAGAGTGGCACCGC
CAGCGTGGTGTGCCTGCTGAACAACTTCTACCCCC
GGGAGGCCAAGGTGCAGTGGAAGGTGGACAACGC
CCTGCAGAGCGGCAACAGCCAGGAGAGCGTCACC
GAGCAGGACAGCAAGGACTCCACCTACAGCCTGA
GCAGCACCCTGACCCTGAGCAAGGCCGACTACGA
GAAGCATAAGGTGTACGCCTGCGAGGTGACCCAC
CAGGGCCTGTCCAGCCCCGTGACCAAGAGCTTCAA
CAGGGGCGAGTGC |

ANTI-HUMAN
ENTPD2 MAB21

| SEQ ID NO: 272 | HCDR1 (KABAT) | EYTMH |
| SEQ ID NO: 273 | HCDR2 (KABAT) | GINPNNGITTYNQKFKG |
| SEQ ID NO: 274 | HCDR3 (KABAT) | RGFPIYYYGTSLYYFDY |
| SEQ ID NO: 275 | HCDR1 (CHOTHIA) | GYTFTEY |
| SEQ ID NO: 276 | HCDR2 (CHOTHIA) | NPNNGI |
| SEQ ID NO: 274 | HCDR3 (CHOTHIA) | RGFPIYYYGTSLYYFDY |
| SEQ ID NO: 277 | HCDR1 (COMBINED) | GYTFTEYTMH |
| SEQ ID NO: 273 | HCDR2 (COMBINED) | GINPNNGITTYNQKFKG |
| SEQ ID NO: 274 | HCDR3 (COMBINED) | RGFPIYYYGTSLYYFDY |
| SEQ ID NO: 278 | HCDR1 (IMGT) | GYTFTEYT |
| SEQ ID NO: 279 | HCDR2 (IMGT) | INPNNGIT |
| SEQ ID NO: 280 | HCDR3 (IMGT) | ARRGFPIYYYGTSLYYFDY |
| SEQ ID NO: 281 | VH | EVQLQQSGPELVKPGASVKISCKTSGYTFTEYTMHW
VKQSHGKSLEWIGGINPNNGITTYNQKFKGKATLTV
DKSSSTAYMDLRSLTSEGSAVYYCARRGFPIYYYGTS
LYYFDYWGQGTTLTVSS |
| SEQ ID NO: 282 | VH DNA | GAGGTCCAGCTGCAACAGTCTGGACCTGAGCTGGT
GAAGCCTGGGGCTTCAGTGAAGATATCCTGCAAGA
CTTCTGGATACACATTCACTGAATACACCATGCAC
TGGGTGAAGCAGAGCCATGGAAAGAGCCTTGAGT |

TABLE 1-continued

Sequences of Exemplary Monoclonal Antibodies (MABs) and
Antibody Fragments (FABs) That Bind Human ENTPD2

|  |  |  |
|---|---|---|
|  |  | GGATTGGAGGTATTAATCCTAACAATGGTATTACT<br>ACTTACAACCAGAAGTTCAAGGGCAAGGCCACATT<br>GACTGTAGACAAGTCCTCCAGCACAGCCTACATGG<br>ACCTCCGCAGCCTGACATCTGAGGGTTCTGCAGTC<br>TATTACTGTGCAAGAAGGGGATTCCCTATTTATTA<br>CTACGGTACTAGCCTCTACTACTTTGACTACTGGG<br>GCCAAGGCACCACTCTCACAGTCTCCTCA |
| SEQ ID NO: 283 | HC | EVQLQQSGPELVKPGASVKISCKTSGYTFTEYTMHW<br>VKQSHGKSLEWIGGINPNNGITTYNQKFKGKATLTV<br>DKSSSTAYMDLRSLTSEGSAVYYCARRGFPIYYYGTS<br>LYYFDYWGQGTTLTVSSASTKGPSVFPLAPSSKSTSG<br>GTAALGCLVKDYFPEPVTVSWNSGALTSGVHTFPAV<br>LQSSGLYSLSSVVTVPSSSLGTQTYICNVNHKPSNTK<br>VDKRVEPKSCDKTHTCPPCPAPELLGGPSVFLFPPKP<br>KDTLMISRTPEVTCVVVDVSHEDPEVKFNWYVDGV<br>EVHNAKTKPREEQYNSTYRVVSVLTVLHQDWLNGK<br>EYKCKVSNKALPAPIEKTISKAKGQPREPQVYTLPPS<br>REEMTKNQVSLTCLVKGFYPSDIAVEWESNGQPENN<br>YKTTPPVLDSDGSFFLYSKLTVDKSRWQQGNVFSCS<br>VMHEALHNHYTQKSLSLSPGK |
| SEQ ID NO: 284 | HC DNA | GAGGTCCAGCTGCAACAGTCTGGACCTGAGCTGGT<br>GAAGCCTGGGGCTTCAGTGAAGATATCCTGCAAGA<br>CTTCTGGATACACATTCACTGAATACACCATGCAC<br>TGGGTGAAGCAGAGCCATGGAAAGAGCCTTGAGT<br>GGATTGGAGGTATTAATCCTAACAATGGTATTACT<br>ACTTACAACCAGAAGTTCAAGGGCAAGGCCACATT<br>GACTGTAGACAAGTCCTCCAGCACAGCCTACATGG<br>ACCTCCGCAGCCTGACATCTGAGGGTTCTGCAGTC<br>TATTACTGTGCAAGAAGGGGATTCCCTATTTATTA<br>CTACGGTACTAGCCTCTACTACTTTGACTACTGGG<br>GCCAAGGCACCACTCTCACAGTCTCCTCAGCTAGC<br>ACCAAGGGCCCAAGTGTGTTTCCCCTGGCCCCCAG<br>CAGCAAGTCTACTTCCGGCGGAACTGCTGCCCTGG<br>GTTGCCTGGTGAAGGACTACTTCCCCGAGCCCGTG<br>ACAGTGTCCTGGAACTCTGGGGCTCTGACTTCCGG<br>CGTGCACACCTTCCCCGCCGTGCTGCAGAGCAGCG<br>GCCTGTACAGCCTGAGCAGCGTGGTGACAGTGCCC<br>TCCAGCTCTCTGGGAACCCAGACCTATATCTGCAA<br>CGTGAACCACAAGCCCAGCAACACCAAGGTGGAC<br>AAGAGAGTGGAGCCCAAGAGCTGCGACAAGACCC<br>ACACCTGCCCCCCCTGCCCAGCTCCAGAACTGCTG<br>GGAGGGCCTTCCGTGTTCCTGTTCCCCCCCAAGCC<br>CAAGGACACCCTGATGATCAGCAGGACCCCCGAG<br>GTGACCTGCGTGGTGGTGGACGTGTCCCACGAGGA<br>CCCAGAGGTGAAGTTCAACTGGTACGTGGACGGC<br>GTGGAGGTGCACAACGCCAAGACCAAGCCCAGAG<br>AGGAGCAGTACAACAGCACCTACAGGGTGGTGTC<br>CGTGCTGACCGTGCTGCACCAGGACTGGCTGAACG<br>GCAAAGAATACAAGTGCAAAGTCTCCAACAAGGC<br>CCTGCCAGCCCCAATCGAAAAGACAATCAGCAAG<br>GCCAAGGGCCAGCCACGGGAGCCCCAGGTGTACA<br>CCCTGCCCCCAGCCGGGAGGAGATGACCAAGAA<br>CCAGGTGTCCCTGACCTGTCTGGTGAAGGGCTTCT<br>ACCCCAGCGATATCGCCGTGGAGTGGGAGAGCAA<br>CGGCCAGCCCGAGAACAACTACAAGACCACCCCC<br>CCAGTGCTGGACAGCGACGGCAGCTTCTTCCTGTA<br>CAGCAAGCTGACCGTGGACAAGTCCAGGTGGCAG<br>CAGGGCAACGTGTTCAGCTGCAGCGTGATGCACGA<br>GGCCCTGCACAACCACTACACCCAGAAGTCCCTGA<br>GCCTGAGCCCCGGCAAG |
| SEQ ID NO: 254 | LCDR1 (KABAT) | SASSSVSYMH |
| SEQ ID NO: 285 | LCDR2 (KABAT) | TTSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 286 | LCDR2 (CHOTHIA) | TTS |
| SEQ ID NO: 19 | LCDR3 (CHOTHIA) | WSSYPW |
| SEQ ID NO: 254 | LCDR1 (COMBINED) | SASSSVSYMH |

TABLE 1-continued

Sequences of Exemplary Monoclonal Antibodies (MAbs) and
Antibody Fragments (FABs) That Bind Human ENTPD2

| SEQ ID NO: 285 | LCDR2 (COMBINED) | TTSNLAS |
|---|---|---|
| SEQ ID NO: 16 | LCDR3 (COMBINED) | HQWSSYPWT |
| SEQ ID NO: 20 | LCDR1 (IMGT) | SSVSY |
| SEQ ID NO: 286 | LCDR2 (IMGT) | TTS |
| SEQ ID NO: 16 | LCDR3 (IMGT) | HQWSSYPWT |
| SEQ ID NO: 287 | VL | QIVLTQSPAIMSASLGEEITLTCSASSSVSYMHWYQQ RSGTSPKLLIYTTSNLASGVPSRFSGSGSGTFYSLTISS VEAEDAADYYCHQWSSYPWTFGGGTKLEIK |
| SEQ ID NO: 288 | VL DNA | CAAATTGTTCTCACCCAGTCTCCAGCAATCATGTCT GCATCTCTAGGGGAGGAGATCACCCTAACCTGCAG TGCCAGCTCGAGTGTAAGTTACATGCACTGGTACC AGCAGAGGTCAGGCACTTCTCCCAAACTCTTGATT TATACCACATCCAACCTGGCTTCTGGAGTCCCTTCT CGCTTCAGTGGCAGTGGGTCTGGGACCTTTTATTCT CTCACAATCAGCAGTGTGGAGGCTGAAGATGCTGC CGATTATTACTGCCATCAGTGGAGTAGTTATCCGT GGACGTTCGGTGGAGGCACCAAGCTGGAAATCAA A |
| SEQ ID NO: 289 | LC | QIVLTQSPAIMSASLGEEITLTCSASSSVSYMHWYQQ RSGTSPKLLIYTTSNLASGVPSRFSGSGSGTFYSLTISS VEAEDAADYYCHQWSSYPWTFGGGTKLEIKRTVAA PSVFIFPPSDEQLKSGTASVVCLLNNFYPREAKVQWK VDNALQSGNSQESVTEQDSKDSTYSLSSTLTLSKADY EKHKVYACEVTHQGLSSPVTKSFNRGEC |
| SEQ ID NO: 290 | LC DNA | CAAATTGTTCTCACCCAGTCTCCAGCAATCATGTCT GCATCTCTAGGGGAGGAGATCACCCTAACCTGCAG TGCCAGCTCGAGTGTAAGTTACATGCACTGGTACC AGCAGAGGTCAGGCACTTCTCCCAAACTCTTGATT TATACCACATCCAACCTGGCTTCTGGAGTCCCTTCT CGCTTCAGTGGCAGTGGGTCTGGGACCTTTTATTCT CTCACAATCAGCAGTGTGGAGGCTGAAGATGCTGC CGATTATTACTGCCATCAGTGGAGTAGTTATCCGT GGACGTTCGGTGGAGGCACCAAGCTGGAAATCAA ACGTACGGTGGCCGCTCCCAGCGTGTTCATCTTCC CCCCCAGCGACGAGCAGCTGAAGAGTGGCACCGC CAGCGTGGTGTGCCTGCTGAACAACTTCTACCCCC GGGAGGCCAAGGTGCAGTGGAAGGTGGACAACGC CCTGCAGAGCGGCAACAGCCAGGAGAGCGTCACC GAGCAGGACAGCAAGGACTCCACCTACAGCCTGA GCAGCACCCTGACCCTGAGCAAGGCCGACTACGA GAAGCATAAGGTGTACGCCTGCGAGGTGACCCAC CAGGGCCTGTCCAGCCCCGTGACCAAGAGCTTCAA CAGGGGCGAGTGC |

| ANTI-HUMAN ENTPD2 FAB22 | | |
|---|---|---|
| SEQ ID NO: 37 | HCDR1 (Kabat) | SGYYWN |
| SEQ ID NO: 220 | HCDR2 (Kabat) | YISYDGDNNYNPSLKN |
| SEQ ID NO: 221 | HCDR3 (Kabat) | GYYRYGLSYYYVMDY |
| SEQ ID NO: 40 | HCDR1 (Chothia) | GYSITSGY |
| SEQ ID NO: 222 | HCDR2 (Chothia) | SYDGD |
| SEQ ID NO: 221 | HCDR3 (Chothia) | GYYRYGLSYYYVMDY |
| SEQ ID NO: 42 | HCDR1 (Combined) | GYSITSGYYWN |
| SEQ ID NO: 220 | HCDR2 (Combined) | YISYDGDNNYNPSLKN |
| SEQ ID NO: 221 | HCDR3 (Combined) | GYYRYGLSYYYVMDY |
| SEQ ID NO: 43 | HCDR1 (IMGT) | GYSITSGYY |

TABLE 1-continued

Sequences of Exemplary Monoclonal Antibodies (MABs) and
Antibody Fragments (FABs) That Bind Human ENTPD2

| SEQ ID NO: | Region | Sequence |
|---|---|---|
| SEQ ID NO: 223 | HCDR2 (IMGT) | ISYDGDN |
| SEQ ID NO: 224 | HCDR3 (IMGT) | AGGYYRYGLSYYYVMDY |
| SEQ ID NO: 328 | VH | EVKLEQSGPGLVKPSQSLSLTCSVTGYSITSGYYWN WIRQFPGNKLEWMSYISYDGDNNYNPSLKNRISITRD TSKNQFFLKLSSVTTEDTATYYCAGGYYRYGLSYYY VMDYWGQGTSVTVSA |
| SEQ ID NO: 329 | VH DNA | GAAGTGAAGCTGGAGCAGTCAGGACCTGGCCTCG TGAAACCTTCTCAGTCTCTGTCTCTCACCTGCTCTG TCACTGGCTACTCCATCACCAGTGGTTATTACTGG AACTGGATCCGGCAGTTTCCAGGAAACAAACTGG AATGGATGAGCTACATAAGCTACGACGGTGACAA TAACTACAACCCATCTCTCAAAAATCGAATCTCCA TCACTCGTGACACATCTAAGAACCAGTTTTTCCTG AAGTTGAGTTCTGTGACTACTGAGGACACAGCTAC ATATTACTGTGCAGGAGGCTACTATAGGTACGGCC TGTCGTATTACTATGTTATGGACTACTGGGGTCAA GGAACCTCAGTCACAGTCTCCGCA |
| SEQ ID NO: 330 | HC | EVKLEQSGPGLVKPSQSLSLTCSVTGYSITSGYYWN WIRQFPGNKLEWMSYISYDGDNNYNPSLKNRISITRD TSKNQFFLKLSSVTTEDTATYYCAGGYYRYGLSYYY VMDYWGQGTSVTVSAASTKGPSVFPLAPSSKSTSGG TAALGCLVKDYFPEPVTVSWNSGALTSGVHTFPAVL QSSGLYSLSSVVTVPSSSLGTQTYICNVNHKPSNTKV DKRVEPKSC |
| SEQ ID NO: 331 | HC DNA | GAAGTGAAGCTGGAGCAGTCAGGACCTGGCCTCG TGAAACCTTCTCAGTCTCTGTCTCTCACCTGCTCTG TCACTGGCTACTCCATCACCAGTGGTTATTACTGG AACTGGATCCGGCAGTTTCCAGGAAACAAACTGG AATGGATGAGCTACATAAGCTACGACGGTGACAA TAACTACAACCCATCTCTCAAAAATCGAATCTCCA TCACTCGTGACACATCTAAGAACCAGTTTTTCCTG AAGTTGAGTTCTGTGACTACTGAGGACACAGCTAC ATATTACTGTGCAGGAGGCTACTATAGGTACGGCC TGTCGTATTACTATGTTATGGACTACTGGGGTCAA GGAACCTCAGTCACAGTCTCCGCAgctagcaccaag ggcccaagtgtgtttccctggccccagcagcaa gtctacttccggcggaactgctgccctgggttgcc tggtgaaggactacttccccgagcccgtgacagtg tcctggaactctggggctctgacttccggcgtgca caccttccccgccgtgctgcagagcagcggcctgta cagcctgagcagcgtggtgacagtgccctccagct ctctgggaacccagacctatatctgcaacgtgaac cacaagcccagcaacaccaaggtggacaagagagtg gagcccaagagctgc |
| SEQ ID NO: 61 | LCDR1 (Kabat) | KASQSVDYDGNSYMN |
| SEQ ID NO: 51 | LCDR2 (Kabat) | AASNLES |
| SEQ ID NO: 52 | LCDR3 (Kabat) | QQSNEDPPT |
| SEQ ID NO: 62 | LCDR1 (Chothia) | SQSVDYDGNSY |
| SEQ ID NO: 54 | LCDR2 (Chothia) | AAS |
| SEQ ID NO: 55 | LCDR3 (Chothia) | SNEDPP |
| SEQ ID NO: 61 | LCDR1 (Combined) | KASQSVDYDGNSYMN |
| SEQ ID NO: 51 | LCDR2 (Combined) | AASNLES |
| SEQ ID NO: 52 | LCDR3 (Combined) | QQSNEDPPT |
| SEQ ID NO: 63 | LCDR1 (IMGT) | QSVDYDGNSY |
| SEQ ID NO: 54 | LCDR2 (IMGT) | AAS |
| SEQ ID NO: 52 | LCDR3 (IMGT) | QQSNEDPPT |
| SEQ ID NO: 332 | VL | DIKMTQSPASLAVSLGQRATISCKASQSVDYDGNSY MNWYQQKPGQPPKLLIYAASNLESGIPARFSGSGSGT |

TABLE 1-continued

Sequences of Exemplary Monoclonal Antibodies (MABs) and
Antibody Fragments (FABs) That Bind Human ENTPD2

| | | |
|---|---|---|
| | | DFTLNIHPVEEEDAATYYCQQSNEDPPTFGGGTKLEL
K |
| SEQ ID NO: 333 | VL DNA | GATATTAAGATGACCCAATCTCCAGCCTCTTTGGC
TGTGTCTCTAGGGCAGAGGGCCACCATCTCCTGCA
AGGCCAGCCAAAGTGTTGATTATGATGGTAATAGT
TATATGAACTGGTACCAACAGAAACCAGGACAGC
CACCCAAACTCCTCATCTATGCTGCATCCAATCTA
GAATCTGGGATCCCAGCCAGGTTTAGTGGCAGTGG
GTCTGGGACAGACTTCACCCTCAACATCCATCCTG
TGGAGGAGGAGGATGCTGCAACCTATTACTGTCAG
CAAAGTAATGAGGATCCTCCGACGTTCGGTGGAGG
CACCAAGCTGGAACTCAAA |
| SEQ ID NO: 334 | LC | DIKMTQSPASLAVSLGQRATISCKASQSVDYDGNSY
MNWYQQKPGQPPKLLIYAASNLESGIPARFSGSGSGT
DFTLNIHPVEEEDAATYYCQQSNEDPPTFGGGTKLEL
KRTVAAPSVFIFPPSDEQLKSGTASVVCLLNNFYPRE
AKVQWKVDNALQSGNSQESVTEQDSKDSTYSLSSTL
TLSKADYEKHKVYACEVTHQGLSSPVTKSFNRGEC |
| SEQ ID NO: 335 | LC DNA | GATATTAAGATGACCCAATCTCCAGCCTCTTTGGC
TGTGTCTCTAGGGCAGAGGGCCACCATCTCCTGCA
AGGCCAGCCAAAGTGTTGATTATGATGGTAATAGT
TATATGAACTGGTACCAACAGAAACCAGGACAGC
CACCCAAACTCCTCATCTATGCTGCATCCAATCTA
GAATCTGGGATCCCAGCCAGGTTTAGTGGCAGTGG
GTCTGGGACAGACTTCACCCTCAACATCCATCCTG
TGGAGGAGGAGGATGCTGCAACCTATTACTGTCAG
CAAAGTAATGAGGATCCTCCGACGTTCGGTGGAGG
CACCAAGCTGGAACTCAAAcgtacggtggccgctc
ccagcgtgttcatcttcccccccagcgacgagcag
ctgaagagtggcaccgccagcgtggtgtgcctgct
gaacaacttctaccccggggaggccaaggtgcagt
ggaaggtggacaacgccctgcagagcggcaacagc
caggagagcgtcaccgagcaggacagcaaggactc
cacctacagcctgagcagcaccctgaccctgagca
aggccgactacgagaagcataaggtgtacgcctgc
gaggtgacccaccagggcctgtccagccccgtgac
caagagcttcaacaggggcgagtgc |

| ANTI-HUMAN
ENTPD2 FAB23 | | |
|---|---|---|
| SEQ ID NO: 1 | HCDR1 (KABAT) | DYNMD |
| SEQ ID NO: 2 | HCDR2 (KABAT) | DINPKYDISTYNQQFKG |
| SEQ ID NO: 3 | HCDR3 (KABAT) | RGFFLYYGINYYYFDV |
| SEQ ID NO: 4 | HCDR1 (CHOTHIA) | GYTFTDY |
| SEQ ID NO: 5 | HCDR2 (CHOTHIA) | NPKYDI |
| SEQ ID NO: 3 | HCDR3 (CHOTHIA) | RGFFLYYGINYYYFDV |
| SEQ ID NO: 6 | HCDR1 (COMBINED) | GYTFTDYNMD |
| SEQ ID NO: 2 | HCDR2 (COMBINED) | DINPKYDISTYNQQFKG |
| SEQ ID NO: 3 | HCDR3 (COMBINED) | RGFFLYYGINYYYFDV |
| SEQ ID NO: 7 | HCDR1 (IMGT) | GYTFTDYN |
| SEQ ID NO: 8 | HCDR2 (IMGT) | INPKYDIS |
| SEQ ID NO: 9 | HCDR3 (IMGT) | ARRGFFLYYGINYYYFDV |
| SEQ ID NO: 233 | VH | EVQLQQFGAELVKPGASVKISCKASGYTFTDYNMD
WVKQSHGKSLEWIGDINPKYDISTYNQQFKGKATLT
VDKSSSTAYMELRSLTSEDTAVYYCARRGFFLYYGI
NYYYFDVWGAGTTVTVSS |
| SEQ ID NO: 234 | VH DNA | GAGGTCCAACTGCAACAGTTTGGAGCTGAACTGGT |

TABLE 1-continued

Sequences of Exemplary Monoclonal Antibodies (MABs) and
Antibody Fragments (FABs) That Bind Human ENTPD2

| | | |
|---|---|---|
| | | GAAGCCTGGGGCTTCAGTGAAGATATCCTGCAAGG<br>CTTCTGGCTACACATTCACTGACTACAACATGGAC<br>TGGGTGAAGCAGAGCCATGGAAAGAGCCTTGAGT<br>GGATTGGAGATATTAATCCTAAGTATGATATTTCT<br>ACCTACAATCAGCAATTCAAGGGAAAGGCCACATT<br>GACTGTAGACAAGTCCTCCAGCACAGCCTACATGG<br>AGCTCCGCAGCCTGACATCTGAGGACACTGCAGTC<br>TATTATTGTGCAAGAAGAGGCTTTTTTCTTTACTAC<br>GGTATTAACTACTATTACTTCGATGTCTGGGGCGC<br>AGGGACCACGGTCACCGTCTCCTCA |
| SEQ ID NO: 336 | HC | EVQLQQFGAELVKPGASVKISCKASGYTFTDYNMD<br>WVKQSHGKSLEWIGDINPKYDISTYNQQFKGKATLT<br>VDKSSSTAYMELRSLTSEDTAVYYCARRGFFLYYGI<br>NYYYFDVWGAGTTVTVSSASTKGPSVFPLAPSSKSTS<br>GGTAALGCLVKDYFPEPVTVSWNSGALTSGVHTFPA<br>VLQSSGLYSLSSVVTVPSSSLGTQTYICNVNFIKPSNT<br>KVDKRVEPKSC |
| SEQ ID NO: 337 | HC DNA | GAGGTCCAACTGCAACAGTTTGGAGCTGAACTGGT<br>GAAGCCTGGGGCTTCAGTGAAGATATCCTGCAAGG<br>CTTCTGGCTACACATTCACTGACTACAACATGGAC<br>TGGGTGAAGCAGAGCCATGGAAAGAGCCTTGAGT<br>GGATTGGAGATATTAATCCTAAGTATGATATTTCT<br>ACCTACAATCAGCAATTCAAGGGAAAGGCCACATT<br>GACTGTAGACAAGTCCTCCAGCACAGCCTACATGG<br>AGCTCCGCAGCCTGACATCTGAGGACACTGCAGTC<br>TATTATTGTGCAAGAAGAGGCTTTTTTCTTTACTAC<br>GGTATTAACTACTATTACTTCGATGTCTGGGGCGC<br>AGGGACCACGGTCACCGTCTCCTCAgctagcacca<br>agggcccaagtgtgtttccctggccccagcagc<br>aagtctacttccggcggaactgctgccctgggttg<br>cctggtgaaggactacttccccgagcccgtgacag<br>tgtcctggaactctggggctctgacttccggcgtg<br>cacaccttccccgccgtgctgcagagcagcggcct<br>gtacagcctgagcagcgtggtgacagtgccctcca<br>gctctctgggaacccagacctatatctgcaacgtg<br>aaccacaagcccagcaacaccaaggtggacaagag<br>agtggagcccaagagctgc |
| SEQ ID NO: 14 | LCDR1 (KABAT) | SASSSVSYIH |
| SEQ ID NO: 15 | LCDR2 (KABAT) | STSNLAS |
| SEQ ID NO: 16 | LCDR3 (KABAT) | HQWSSYPWT |
| SEQ ID NO: 17 | LCDR1 (CHOTHIA) | SSSVSY |
| SEQ ID NO: 18 | LCDR2 (CHOTHIA) | STS |
| SEQ ID NO: 19 | LCDR3 (CHOTHIA) | WSSYPW |
| SEQ ID NO: 14 | LCDR1 (COMBINED) | SASSSVSYIH |
| SEQ ID NO: 15 | LCDR2 (COMBINED) | STSNLAS |
| SEQ ID NO: 16 | LCDR3 (COMBINED) | HQWSSYPWT |
| SEQ ID NO: 20 | LCDR1 (IMGT) | SSVSY |
| SEQ ID NO: 18 | LCDR2 (IMGT) | STS |
| SEQ ID NO: 16 | LCDR3 (IMGT) | HQWSSYPWT |
| SEQ ID NO: 237 | VL | QIVLTQSPAIMSASLGEEITLTCSASSSVSYIHWYQQK<br>SGTSPTLLIYSTSNLASGVPSRFSGSGSGTFYSLTISSV<br>EAEDAADYYCHQWSSYPWTFGGGTKLEIK |
| SEQ ID NO: 238 | VL DNA | CAAATTGTTCTCACCCAGTCTCCAGCAATCATGTCT<br>GCATCTCTAGGGGAGGAGATCACCCTAACCTGCAG<br>TGCCAGCTCGAGTGTAAGTTACATACACTGGTACC<br>AGCAGAAGTCAGGCACTTCTCCCACACTCTTGATT<br>TATAGCACATCCAATCTGGCTTCTGGAGTCCCTTCT<br>CGCTTCAGTGGCAGTGGGTCTGGGACCTTTTATTCT |

TABLE 1-continued

Sequences of Exemplary Monoclonal Antibodies (MABs) and
Antibody Fragments (FABs) That Bind Human ENTPD2

|  |  |  |
|---|---|---|
|  |  | CTCACAATCAGCAGTGTGGAGGCTGAAGATGCTGC<br>CGATTATTACTGCCATCAGTGGAGTAGTTATCCAT<br>GGACGTTCGGTGGAGGCACCAAGCTGGAAATCAA<br>A |
| SEQ ID NO: 239 | LC | QIVLTQSPAIMSASLGEEITLTCSASSSVSYIHWYQQK<br>SGTSPTLLIYSTSNLASGVPSRFSGSGSGTFYSLTISSV<br>EAEDAADYYCHQWSSYPWTFGGGTKLEIKRTVAAP<br>SVFIFPPSDEQLKSGTASVVCLLNNFYPREAKVQWKV<br>DNALQSGNSQESVTEQDSKDSTYSLSSTLTLSKADYE<br>KHKVYACEVTHQGLSSPVTKSFNRGEC |
| SEQ ID NO: 240 | LC DNA | CAAATTGTTCTCACCCAGTCTCCAGCAATCATGTCT<br>GCATCTCTAGGGGAGGAGATCACCCTAACCTGCAG<br>TGCCAGCTCGAGTGTAAGTTACATACACTGGTACC<br>AGCAGAAGTCAGGCACTTCTCCCACACTCTTGATT<br>TATAGCACATCCAATCTGGCTTCTGGAGTCCCTTCT<br>CGCTTCAGTGGCAGTGGGTCTGGGACCTTTTATTCT<br>CTCACAATCAGCAGTGTGGAGGCTGAAGATGCTGC<br>CGATTATTACTGCCATCAGTGGAGTAGTTATCCAT<br>GGACGTTCGGTGGAGGCACCAAGCTGGAAATCAA<br>ACGTACGGTGGCCGCTCCCAGCGTGTTCATCTTCC<br>CCCCCAGCGACGAGCAGCTGAAGAGTGGCACCGC<br>CAGCGTGGTGTGCCTGCTGAACAACTTCTACCCCC<br>GGGAGGCCAAGGTGCAGTGGAAGGTGGACAACGC<br>CCTGCAGAGCGGCAACAGCCAGGAGAGCGTCACC<br>GAGCAGGACAGCAAGGACTCCACCTACAGCCTGA<br>GCAGCACCCTGACCCTGAGCAAGGCCGACTACGA<br>GAAGCATAAGGTGTACGCCTGCGAGGTGACCCAC<br>CAGGGCCTGTCCAGCCCCGTGACCAAGAGCTTCAA<br>CAGGGGCGAGTGC |

In some embodiments, the anti-human ENTPD2 antibody or antibody fragment (e.g., an antigen binding fragment) comprises a VH domain having an amino acid sequence of any VH domain described in Table 1. Other suitable anti-human ENTPD2 antibodies or antibody fragments (e.g., antigen binding fragments) can include amino acids that have been mutated, yet have at least 80, 85, 90, 95, 96, 97, 98, or 99 percent identity in the VH domain with the VH regions depicted in the sequences described in Table 1. The present disclosure in certain embodiments also provides antibodies or antibody fragments (e.g., antigen binding fragments) that specifically bind to human ENTPD2, wherein the antibodies or antibody fragments (e.g., antigen binding fragments) comprise a VH CDR having an amino acid sequence of any one of the VH CDRs listed in Table 1. In particular embodiments, the invention provides antibodies or antibody fragments (e.g., antigen binding fragments) that specifically bind to human ENTPD2, comprising (or alternatively, consist of) one, two, three, four, five or more VH CDRs having an amino acid sequence of any one of the VH CDRs listed in Table 1.

In some embodiments, the anti-human ENTPD2 antibody or antibody fragment (e.g., antigen binding fragment) comprises a VL domain having an amino acid sequence of any VL domain described in Table 1. Other suitable anti-human ENTPD2 antibodies or antibody fragments (e.g., antigen binding fragments) can include amino acids that have been mutated, yet have at least 80, 85, 90, 95, 96, 97, 98, or 99 percent identity in the VL domain with the VL regions depicted in the sequences described in Table 1. The present disclosure also provides antibodies or antibody fragments (e.g., antigen binding fragments) that specifically bind to human ENTPD2, the antibodies or antibody fragments (e.g., antigen binding fragments) comprise a VL CDR having an amino acid sequence of any one of the VL CDRs listed in Table 1. In particular, the invention provides antibodies or antibody fragments (e.g., antigen binding fragments) that specifically bind to human ENTPD2, which comprise (or alternatively, consist of) one, two, three or more VL CDRs having an amino acid sequence of any one of the VL CDRs listed in Table 1.

Other anti-human ENTPD2 antibodies or antibody fragments (e.g., antigen binding fragment) disclosed herein include amino acids that have been mutated, yet have at least 80, 85, 90, 95, 96, 97, 98, or 99 percent identity in the CDR regions with the CDR regions depicted in the sequences described in Table 1. In some embodiments, it includes mutant amino acid sequences wherein no more than 1, 2, 3, 4 or 5 amino acids have been mutated in the CDR regions when compared with the CDR regions depicted in the sequence described in Table 1.

Also provided herein are nucleic acid sequences that encode VH, VL, full length heavy chain, and full length light chain of antibodies and antigen binding fragments thereof that specifically bind to human ENTPD2, e.g., the nucleic acid sequences in Table 1. Such nucleic acid sequences can be optimized for expression in mammalian cells.

Other anti-human ENTPD2 antibodies disclosed herein include those where the amino acids or nucleic acids encoding the amino acids have been mutated, yet have at least 80, 85, 90 95, 96, 97, 98, or 99 percent identity to the sequences described in Table 1. In some embodiments, antibodies or antigen binding fragments thereof include mutant amino acid sequences wherein no more than 1, 2, 3, 4 or 5 amino acids have been mutated in the variable regions when compared with the variable regions depicted in the sequence described in Table 1, while retaining substantially the same therapeutic activity.

Since each provided antibody binds to human ENTPD2, the VH, VL, full length light chain, and full length heavy chain sequences (amino acid sequences and the nucleotide sequences encoding the amino acid sequences) can be "mixed and matched" to create other ENTPD2-binding antibodies disclosed herein. Such "mixed and matched" ENTPD2-binding antibodies can be tested using binding assays known in the art (e.g., ELISAs, assays described in the Exemplification). When chains are mixed and matched, a VH sequence from a particular VH/VL pairing should be replaced with a structurally similar VH sequence. A full length heavy chain sequence from a particular full length heavy chain/full length light chain pairing should be replaced with a structurally similar full length heavy chain sequence. A VL sequence from a particular VH/VL pairing should be replaced with a structurally similar VL sequence. A full length light chain sequence from a particular full length heavy chain/full length light chain pairing should be replaced with a structurally similar full length light chain sequence.

Accordingly, in one embodiment, the invention provides an isolated monoclonal antibody or antigen binding fragment thereof having: a heavy chain variable region (VH) comprising an amino acid sequence selected from any one of SEQ ID NOs: 10, 25, 33, 46, 70, 91, 115, 132, 145, 169, 225, 233, 241, 250, 264, 281, 328; and a light chain variable region (VL) comprising an amino acid sequence selected from any one of SEQ ID NOs: 21, 29, 57, 64, 74, 78, 102, 125, 156, 178, 229, 237, 257, 268, 287, 332; wherein the antibody specifically binds to human ENTPD2.

In another embodiment, the invention provides (i) an isolated monoclonal antibody having: a full length heavy chain (HC) comprising an amino acid sequence selected from any one of SEQ ID NOs: 12, 27, 35, 48, 72, 93, 117, 134, 147, 171, 227, 235, 243, 252, 266, 283, 330; and a full length light chain (LC) comprising an amino acid sequence selected from any one of SEQ ID NOs: 23, 31, 59, 66, 76, 80, 104, 127, 158, 180, 231, 239, 259, 270, 289, 334; or (ii) a functional protein comprising an antigen binding portion thereof.

In another embodiment, the present disclosure provides human ENTPD2-binding antibodies or antibody fragments thereof that comprise the heavy chain CDR1, CDR2 and CDR3 and light chain CDR1, CDR2 and CDR3 as described in Table 1, or combinations thereof. The amino acid sequences of the VH CDR's of the antibodies are shown in SEQ ID NOs: 1, 4, 6, 7, 37, 40, 42, 43, 82, 85, 87, 88, 106, 109, 111, 112, 136, 139, 141, 142, 160, 163, 165, 166, 185, 187, 188, 206, 207, 208, 213, 214, 215, 272, 275, 277. The amino acid sequences of the VH CDR2s of the antibodies and are shown in SEQ ID NOs: 2, 5, 8, 38, 41, 44, 83, 86, 89, 107, 110, 113, 129, 130, 131, 137, 140, 143, 161, 164, 167, 186, 189, 220, 222, 223, 245, 247, 248, 261, 273, 276, 279. The amino acid sequences of the VH CDR3s of the antibodies are shown in SEQ ID NO: 3, 39, 68, 84, 108, 138, 162, 221, 246, 262, 277, 274, 9, 45, 69, 90, 114, 144, 168, 190, 224, 249, 263, 274, 280. The amino acid sequences of the VL CDR's of the antibodies are shown in SEQ ID NOs: 14, 17, 20, 50, 53, 56, 61, 62, 63, 95, 98, 101, 119, 122, 124, 149, 152, 155, 173, 175, 177, 198, 201, 254. The amino acid sequences of the VL CDR2s of the antibodies are shown in SEQ ID NOs: 15, 18, 51, 54, 96, 99, 120, 150, 153, 199, 285, 286. The amino acid sequences of the VL CDR3s of the antibodies are shown in SEQ ID NOs: 16, 19, 52, 55, 97, 100, 121, 123, 151, 154, 174, 176, 200, 255, 256.

Given that each of the antibodies binds human ENTPD2 and that antigen-binding specificity is provided primarily by the CDR1, CDR2 and CDR3 regions, the VH CDR1, CDR2 and CDR3 sequences and VL CDR1, CDR2 and CDR3 sequences can be "mixed and matched" (i.e., CDRs from different antibodies can be mixed and matched), although each antibody must contain a VH CDR1, CDR2 and CDR3 and a VL CDR1, CDR2 and CDR3 to create other human ENTPD2-binding antibodies disclosed herein. Such "mixed and matched" ENTPD2-binding antibodies can be tested using the binding assays known in the art and those described in the Examples (e.g., ELISAs). When VH CDR sequences are mixed and matched, the CDR1, CDR2 and/or CDR3 sequence from a particular VH sequence should be replaced with a structurally similar CDR sequence(s). Likewise, when VL CDR sequences are mixed and matched, the CDR1, CDR2 and/or CDR3 sequence from a particular VL sequence should be replaced with a structurally similar CDR sequence(s). It will be readily apparent to the ordinarily skilled artisan that novel VH and VL sequences can be created by substituting one or more VH and/or VL CDR region sequences with structurally similar sequences from CDR sequences shown herein for monoclonal antibodies of the present disclosure.

Accordingly, the present disclosure provides an isolated monoclonal antibody or antigen binding region thereof comprising a heavy chain CDR1 comprising an amino acid sequence selected from the group consisting of SEQ ID NOs: 1, 4, 6, 7, 37, 40, 42, 43, 82, 85, 87, 88, 106, 109, 111, 112, 136, 139, 141, 142, 160, 163, 165, 166, 182, 187, 188, 206, 207, 208, 213, 214, 215, 272, 275, 277; a heavy chain CDR2 comprising an amino acid sequence selected from the group consisting of SEQ ID NOs: 2, 5, 8, 38, 41, 44, 83, 86, 89, 107, 110, 113, 129, 130, 131, 137, 140, 143, 161, 164, 167, 183, 189, 220, 222, 223, 245, 247, 248, 261, 273, 276; a heavy chain CDR3 comprising an amino acid sequence selected from the group consisting of SEQ ID NO: 3, 39, 68, 84, 108, 138, 162, 221, 246, 262, 277, 274, 9, 45, 69, 90, 114, 144, 168, 190, 224, 249, 263, 274, 280; a light chain CDR1 comprising an amino acid sequence selected from the group consisting of SEQ ID NOs: 14, 17, 20, 50, 53, 56, 61, 62, 63, 95, 98, 101, 119, 122, 124, 149, 152, 155, 173, 175, 177, 195, 201, 254; a light chain CDR2 comprising an amino acid sequence selected from the group consisting of SEQ ID NOs: 15, 18, 51, 54, 96, 99, 120, 150, 153, 196, 285, 286; and a light chain CDR3 comprising an amino acid sequence selected from the group consisting of SEQ ID NOs: 16, 19, 52, 55, 97, 100, 121, 123, 151, 154, 174, 176, 197, 255, 256; wherein the antibody specifically binds human ENTPD2.

In certain embodiments, an antibody that specifically binds to human ENTPD2 is an antibody or antibody fragment (e.g., antigen binding fragment) that is described in Table 1.

In some embodiments, the antibody or antigen binding region thereof that specifically binds to human ENTPD2 comprises a heavy chain complementarity determining region 1 (HCDR1) comprising the amino acid sequence of SEQ ID NO: 1, 4, 6 or 7; a heavy chain complementarity determining region 2 (HCDR2) comprising the amino acid sequence of SEQ ID NO: 2, 5 or 8; a heavy chain complementarity determining region 3 (HCDR3) comprising the amino acid sequence of SEQ ID NO: 3 or 9; a light chain complementarity determining region 1 (LCDR1) comprising the amino acid sequence of SEQ ID NO: 14, 17, or 20; a light chain complementarity determining region 2 (LCDR2) comprising the amino acid sequence of SEQ ID NO:15 or 18; and a light chain complementarity determining region 3 (LCDR3) comprising the amino acid sequence of SEQ ID NO: 16 or 19.

In some embodiments, the antibody or antigen binding region thereof that specifically binds to human ENTPD2 comprises an HCDR1 comprising the amino acid sequence of SEQ ID NO: 1; an HCDR2 comprising the amino acid sequence of SEQ ID NO: 2; an HCDR3 comprising the amino acid sequence of SEQ ID NO: 3; an LCDR1 comprising the amino acid sequence of SEQ ID NO: 14; an LCDR2 comprising the amino acid sequence of SEQ ID NO: 15; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 4; an HCDR2 comprising the amino acid sequence of SEQ ID NO: 5; an HCDR3 comprising the amino acid sequence of SEQ ID NO: 3; an LCDR1 comprising the amino acid sequence of SEQ ID NO: 17; an LCDR2 comprising the amino acid sequence of SEQ ID NO: 18; and an LCDR3 comprising the amino acid sequence of SEQ ID NO: 19.

In some embodiments, the antibody or antigen binding region thereof that specifically binds to human ENTPD2 comprises an HCDR1 comprising the amino acid sequence of SEQ ID NO: 6; an HCDR2 comprising the amino acid sequence of SEQ ID NO: 2; an HCDR3 comprising the amino acid sequence of SEQ ID NO: 3; an LCDR1 comprising the amino acid sequence of SEQ ID NO: 14; an LCDR2 comprising the amino acid sequence of SEQ ID NO: 15; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 7; an HCDR2 comprising the amino acid sequence of SEQ ID NO: 8; an HCDR3 comprising the amino acid sequence of SEQ ID NO: 9; an LCDR1 comprising the amino acid sequence of SEQ ID NO: 20; an LCDR2 comprising the amino acid sequence of SEQ ID NO: 18; and an LCDR3 comprising the amino acid sequence of SEQ ID NO: 16.

In some embodiments, the antibody or antigen binding region thereof that specifically binds to human ENTPD2 comprises a HCDR1 comprising the amino acid sequence of SEQ ID NO: 37, 40, 42 or 43; a HCDR2 comprising the amino acid sequence of SEQ ID NO: 38, 41, or 44; a HCDR3 comprising the amino acid sequence of SEQ ID NO: 39 or 45; a LCDR1 comprising the amino acid sequence of SEQ ID NO: 50, 53 or 56; a LCDR2 comprising the amino acid sequence of SEQ ID NO: 51 or 54; and a LCDR3 comprising the amino acid sequence of SEQ ID NO: 52 or 55.

In some embodiments, the antibody or antigen binding region thereof that specifically binds to human ENTPD2 comprises an HCDR1 comprising the amino acid sequence of SEQ ID NO: 37; an HCDR2 comprising the amino acid sequence of SEQ ID NO: 38; an HCDR3 comprising the amino acid sequence of SEQ ID NO: 39; an LCDR1 comprising the amino acid sequence of SEQ ID NO: 50; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 40; an HCDR2 comprising the amino acid sequence of SEQ ID NO: 41; an HCDR3 comprising the amino acid sequence of SEQ ID NO: 39; an LCDR1 comprising the amino acid sequence of SEQ ID NO: 53; an LCDR2 comprising the amino acid sequence of SEQ ID NO: 54; and an LCDR3 comprising the amino acid sequence of SEQ ID NO: 55.

In some embodiments, the antibody or antigen binding region thereof that specifically binds to human ENTPD2 comprises an HCDR1 comprising the amino acid sequence of SEQ ID NO: 42; an HCDR2 comprising the amino acid sequence of SEQ ID NO: 38; an HCDR3 comprising the amino acid sequence of SEQ ID NO: 39; an LCDR1 comprising the amino acid sequence of SEQ ID NO: 50; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 43; an HCDR2 comprising the amino acid sequence of SEQ ID NO: 44; an HCDR3 comprising the amino acid sequence of SEQ ID NO: 45; an LCDR1 comprising the amino acid sequence of SEQ ID NO: 56; an LCDR2 comprising the amino acid sequence of SEQ ID NO: 54; and an LCDR3 comprising the amino acid sequence of SEQ ID NO: 52.

In some embodiments, the antibody or antigen binding region thereof that specifically binds to human ENTPD2 comprises a HCDR1 comprising the amino acid sequence of SEQ ID NO: 37, 40, 42 or 43; a HCDR2 comprising the amino acid sequence of SEQ ID NO: 38, 41, or 44; a HCDR3 comprising the amino acid sequence of SEQ ID NO: 39 or 45; a LCDR1 comprising the amino acid sequence of SEQ ID NO: 61, 62, or 63; a LCDR2 comprising the amino acid sequence of SEQ ID NO: 51 or 54; and a LCDR3 comprising the amino acid sequence of SEQ ID NO: 52 or 55.

In some embodiments, the antibody or antigen binding region thereof that specifically binds to human ENTPD2 comprises an HCDR1 comprising the amino acid sequence of SEQ ID NO: 37; an HCDR2 comprising the amino acid sequence of SEQ ID NO: 38; an HCDR3 comprising the amino acid sequence of SEQ ID NO: 39; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 40; an HCDR2 comprising the amino acid sequence of SEQ ID NO: 41; an HCDR3 comprising the amino acid sequence of SEQ ID NO: 39; an LCDR1 comprising the amino acid sequence of SEQ ID NO: 62; an LCDR2 comprising the amino acid sequence of SEQ ID NO: 54; and an LCDR3 comprising the amino acid sequence of SEQ ID NO: 55.

In some embodiments, the antibody or antigen binding region thereof that specifically binds to human ENTPD2 comprises an HCDR1 comprising the amino acid sequence of SEQ ID NO: 42; an HCDR2 comprising the amino acid sequence of SEQ ID NO: 38; an HCDR3 comprising the amino acid sequence of SEQ ID NO: 39; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 43; an HCDR2 comprising the amino acid sequence of SEQ ID NO: 44; an HCDR3 comprising the amino acid sequence of SEQ ID NO: 45; an LCDR1 comprising the amino acid sequence of SEQ ID NO: 63; an LCDR2 comprising the amino acid sequence of SEQ ID NO: 54; and an LCDR3 comprising the amino acid sequence of SEQ ID NO: 52.

In some embodiments, the antibody or antigen binding region thereof that specifically binds to human ENTPD2 comprises a HCDR1 comprising the amino acid sequence of SEQ ID NO: 37, 40, 42 or 43; a HCDR2 comprising the amino acid sequence of SEQ ID NO: 38, 41, or 44; a HCDR3 comprising the amino acid sequence of SEQ ID NO: 68 or 69; a LCDR1 comprising the amino acid sequence of SEQ ID NO: 50, 53 or 56; a LCDR2 comprising the amino acid sequence of SEQ ID NO: 51 or 54; and a LCDR3 comprising the amino acid sequence of SEQ ID NO: 52 or 55.

In some embodiments, the antibody or antigen binding region thereof that specifically binds to human ENTPD2 comprises an HCDR1 comprising the amino acid sequence of SEQ ID NO: 37; an HCDR2 comprising the amino acid sequence of SEQ ID NO: 38; an HCDR3 comprising the amino acid sequence of SEQ ID NO: 68; an LCDR1 comprising the amino acid sequence of SEQ ID NO: 50; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 40; an HCDR2 comprising the amino acid sequence of SEQ ID NO: 41; an HCDR3 comprising the amino acid sequence of SEQ ID NO: 68; an LCDR1 comprising the amino acid sequence of SEQ ID NO: 53; an LCDR2 comprising the amino acid sequence of SEQ ID NO: 54; and an LCDR3 comprising the amino acid sequence of SEQ ID NO: 55.

In some embodiments, the antibody or antigen binding region thereof that specifically binds to human ENTPD2 comprises an HCDR1 comprising the amino acid sequence of SEQ ID NO: 42; an HCDR2 comprising the amino acid sequence of SEQ ID NO: 38; an HCDR3 comprising the amino acid sequence of SEQ ID NO: 68; an LCDR1 comprising the amino acid sequence of SEQ ID NO: 50; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 43; an HCDR2 comprising the amino acid sequence of SEQ ID NO: 44; an HCDR3 comprising the amino acid sequence of SEQ ID NO: 69; an LCDR1 comprising the amino acid sequence of SEQ ID NO: 56; an LCDR2 comprising the amino acid sequence of SEQ ID NO: 54; and an LCDR3 comprising the amino acid sequence of SEQ ID NO: 52.

In some embodiments, the antibody or antigen binding region thereof that specifically binds to human ENTPD2 comprises a HCDR1 comprising the amino acid sequence of SEQ ID NO: 82, 85, 87, or 88; a HCDR2 comprising the amino acid sequence of SEQ ID NO: 83, 86, or 89; a HCDR3 comprising the amino acid sequence of SEQ ID NO: 84 or 90; a LCDR1 comprising the amino acid sequence of SEQ ID NO: 95, 98, or 101; a LCDR2 comprising the amino acid sequence of SEQ ID NO: 96 or 99; and a LCDR3 comprising the amino acid sequence of SEQ ID NO: 97 or 100.

In some embodiments, the antibody or antigen binding region thereof that specifically binds to human ENTPD2 comprises an HCDR1 comprising the amino acid sequence of SEQ ID NO: 82; an HCDR2 comprising the amino acid sequence of SEQ ID NO: 83; an HCDR3 comprising the amino acid sequence of SEQ ID NO: 84; an LCDR1 comprising the amino acid sequence of SEQ ID NO: 95; an LCDR2 comprising the amino acid sequence of SEQ ID NO: 96; and an LCDR3 comprising the amino acid sequence of SEQ ID NO: 97.

In some embodiments, the antibody or antigen binding region thereof that specifically binds to human ENTPD2 comprises an HCDR1 comprising the amino acid sequence of SEQ ID NO: 85; an HCDR2 comprising the amino acid sequence of SEQ ID NO: 86; an HCDR3 comprising the amino acid sequence of SEQ ID NO: 84; an LCDR1 comprising the amino acid sequence of SEQ ID NO: 98; an LCDR2 comprising the amino acid sequence of SEQ ID NO: 99; and an LCDR3 comprising the amino acid sequence of SEQ ID NO: 100.

In some embodiments, the antibody or antigen binding region thereof that specifically binds to human ENTPD2 comprises an HCDR1 comprising the amino acid sequence of SEQ ID NO: 87; an HCDR2 comprising the amino acid sequence of SEQ ID NO: 83; an HCDR3 comprising the amino acid sequence of SEQ ID NO: 84; an LCDR1 comprising the amino acid sequence of SEQ ID NO: 95; an LCDR2 comprising the amino acid sequence of SEQ ID NO: 96; and an LCDR3 comprising the amino acid sequence of SEQ ID NO: 97.

In some embodiments, the antibody or antigen binding region thereof that specifically binds to human ENTPD2 comprises an HCDR1 comprising the amino acid sequence of SEQ ID NO: 88; an HCDR2 comprising the amino acid sequence of SEQ ID NO: 89; an HCDR3 comprising the amino acid sequence of SEQ ID NO: 90; an LCDR1 comprising the amino acid sequence of SEQ ID NO: 101; an LCDR2 comprising the amino acid sequence of SEQ ID NO: 99; and an LCDR3 comprising the amino acid sequence of SEQ ID NO: 97.

In some embodiments, the antibody or antigen binding region thereof that specifically binds to human ENTPD2 comprises a HCDR1 comprising the amino acid sequence of SEQ ID NO: 106, 109, 111, or 112; a HCDR2 comprising the amino acid sequence of SEQ ID NO: 107, 110, or 113; a HCDR3 comprising the amino acid sequence of SEQ ID NO: 108 or 114; a LCDR1 comprising the amino acid sequence of SEQ ID NO: 119, 122, or 124; a LCDR2 comprising the amino acid sequence of SEQ ID NO: 99 or 120; and a LCDR3 comprising the amino acid sequence of SEQ ID NO: 121 or 123.

In some embodiments, the antibody or antigen binding region thereof that specifically binds to human ENTPD2 comprises an HCDR1 comprising the amino acid sequence of SEQ ID NO: 106; an HCDR2 comprising the amino acid sequence of SEQ ID NO: 107; an HCDR3 comprising the amino acid sequence of SEQ ID NO: 108; an LCDR1 comprising the amino acid sequence of SEQ ID NO: 119; an LCDR2 comprising the amino acid sequence of SEQ ID NO: 120; and an LCDR3 comprising the amino acid sequence of SEQ ID NO: 121.

In some embodiments, the antibody or antigen binding region thereof that specifically binds to human ENTPD2 comprises an HCDR1 comprising the amino acid sequence of SEQ ID NO: 109; an HCDR2 comprising the amino acid sequence of SEQ ID NO: 110; an HCDR3 comprising the amino acid sequence of SEQ ID NO: 108; an LCDR1 comprising the amino acid sequence of SEQ ID NO: 122; an LCDR2 comprising the amino acid sequence of SEQ ID NO: 99; and an LCDR3 comprising the amino acid sequence of SEQ ID NO: 123.

In some embodiments, the antibody or antigen binding region thereof that specifically binds to human ENTPD2 comprises an HCDR1 comprising the amino acid sequence of SEQ ID NO: 111; an HCDR2 comprising the amino acid sequence of SEQ ID NO: 107; an HCDR3 comprising the amino acid sequence of SEQ ID NO: 119; an LCDR1 comprising the amino acid sequence of SEQ ID NO: 120; an LCDR2 comprising the amino acid sequence of SEQ ID NO: 121; and an LCDR3 comprising the amino acid sequence of SEQ ID NO: 108.

In some embodiments, the antibody or antigen binding region thereof that specifically binds to human ENTPD2 comprises an HCDR1 comprising the amino acid sequence of SEQ ID NO: 112; an HCDR2 comprising the amino acid sequence of SEQ ID NO: 113; an HCDR3 comprising the amino acid sequence of SEQ ID NO: 114; an LCDR1 comprising the amino acid sequence of SEQ ID NO: 124; an LCDR2 comprising the amino acid sequence of SEQ ID NO: 99; and an LCDR3 comprising the amino acid sequence of SEQ ID NO: 121.

In some embodiments, the antibody or antigen binding region thereof that specifically binds to human ENTPD2 comprises a HCDR1 comprising the amino acid sequence of SEQ ID NO: 106, 109, 111, or 112; a HCDR2 comprising the amino acid sequence of SEQ ID NO: 129, 130, or 131; a HCDR3 comprising the amino acid sequence of SEQ ID NO: 108 or 114; a LCDR1 comprising the amino acid sequence of SEQ ID NO: 119, 122, or 124; a LCDR2 comprising the amino acid sequence of SEQ ID NO: 99 or 120; and a LCDR3 comprising the amino acid sequence of SEQ ID NO: 121 or 123.

In some embodiments, the antibody or antigen binding region thereof that specifically binds to human ENTPD2 comprises an HCDR1 comprising the amino acid sequence of SEQ ID NO: 106; an HCDR2 comprising the amino acid sequence of SEQ ID NO: 129; an HCDR3 comprising the amino acid sequence of SEQ ID NO: 108; an LCDR1 comprising the amino acid sequence of SEQ ID NO: 119; an LCDR2 comprising the amino acid sequence of SEQ ID NO: 120; and an LCDR3 comprising the amino acid sequence of SEQ ID NO: 121.

In some embodiments, the antibody or antigen binding region thereof that specifically binds to human ENTPD2 comprises an HCDR1 comprising the amino acid sequence of SEQ ID NO: 109; an HCDR2 comprising the amino acid sequence of SEQ ID NO: 130; an HCDR3 comprising the amino acid sequence of SEQ ID NO: 108; an LCDR1 comprising the amino acid sequence of SEQ ID NO: 122; an LCDR2 comprising the amino acid sequence of SEQ ID NO: 99; and an LCDR3 comprising the amino acid sequence of SEQ ID NO: 123.

In some embodiments, the antibody or antigen binding region thereof that specifically binds to human ENTPD2 comprises an HCDR1 comprising the amino acid sequence of SEQ ID NO: 111; an HCDR2 comprising the amino acid sequence of SEQ ID NO: 129; an HCDR3 comprising the amino acid sequence of SEQ ID NO: 108; an LCDR1 comprising the amino acid sequence of SEQ ID NO: 119; an LCDR2 comprising the amino acid sequence of SEQ ID NO: 120; and an LCDR3 comprising the amino acid sequence of SEQ ID NO: 121.

In some embodiments, the antibody or antigen binding region thereof that specifically binds to human ENTPD2 comprises an HCDR1 comprising the amino acid sequence of SEQ ID NO: 112; an HCDR2 comprising the amino acid sequence of SEQ ID NO: 131; an HCDR3 comprising the amino acid sequence of SEQ ID NO: 114; an LCDR1 comprising the amino acid sequence of SEQ ID NO: 124; an LCDR2 comprising the amino acid sequence of SEQ ID NO: 99; and an LCDR3 comprising the amino acid sequence of SEQ ID NO: 121.

In some embodiments, the antibody or antigen binding region thereof that specifically binds to human ENTPD2 comprises a HCDR1 comprising the amino acid sequence of SEQ ID NO: 136, 139, 141, or 142; a HCDR2 comprising the amino acid sequence of SEQ ID NO: 137, 140, or 143; a HCDR3 comprising the amino acid sequence of SEQ ID NO: 138 or 144; a LCDR1 comprising the amino acid sequence of SEQ ID NO: 149, 152, or 155; a LCDR2 comprising the amino acid sequence of SEQ ID NO: 150 or 153; and a LCDR3 comprising the amino acid sequence of SEQ ID NO: 151 or 154.

In some embodiments, the antibody or antigen binding region thereof that specifically binds to human ENTPD2 comprises an HCDR1 comprising the amino acid sequence of SEQ ID NO: 136; an HCDR2 comprising the amino acid sequence of SEQ ID NO: 137; an HCDR3 comprising the amino acid sequence of SEQ ID NO: 138; an LCDR1 comprising the amino acid sequence of SEQ ID NO: 149; an LCDR2 comprising the amino acid sequence of SEQ ID NO: 150; and an LCDR3 comprising the amino acid sequence of SEQ ID NO: 151.

In some embodiments, the antibody or antigen binding region thereof that specifically binds to human ENTPD2 comprises an HCDR1 comprising the amino acid sequence of SEQ ID NO: 139; an HCDR2 comprising the amino acid sequence of SEQ ID NO: 140; an HCDR3 comprising the amino acid sequence of SEQ ID NO: 138; an LCDR1 comprising the amino acid sequence of SEQ ID NO: 152; an LCDR2 comprising the amino acid sequence of SEQ ID NO: 153; and an LCDR3 comprising the amino acid sequence of SEQ ID NO: 154.

In some embodiments, the antibody or antigen binding region thereof that specifically binds to human ENTPD2 comprises an HCDR1 comprising the amino acid sequence of SEQ ID NO: 141; an HCDR2 comprising the amino acid sequence of SEQ ID NO: 137; an HCDR3 comprising the amino acid sequence of SEQ ID NO: 138; an LCDR1 comprising the amino acid sequence of SEQ ID NO: 149; an LCDR2 comprising the amino acid sequence of SEQ ID NO: 150; and an LCDR3 comprising the amino acid sequence of SEQ ID NO: 151.

In some embodiments, the antibody or antigen binding region thereof that specifically binds to human ENTPD2 comprises an HCDR1 comprising the amino acid sequence of SEQ ID NO: 142; an HCDR2 comprising the amino acid sequence of SEQ ID NO: 143; an HCDR3 comprising the amino acid sequence of SEQ ID NO: 144; an LCDR1 comprising the amino acid sequence of SEQ ID NO: 155; an LCDR2 comprising the amino acid sequence of SEQ ID NO: 153; and an LCDR3 comprising the amino acid sequence of SEQ ID NO: 151.

In some embodiments, the antibody or antigen binding region thereof that specifically binds to human ENTPD2 comprises a HCDR1 comprising the amino acid sequence of SEQ ID NO: 160, 163, 165, or 166; a HCDR2 comprising the amino acid sequence of SEQ ID NO: 161, 164, or 167; a HCDR3 comprising the amino acid sequence of SEQ ID NO: 162 or 168; a LCDR1 comprising the amino acid sequence of SEQ ID NO: 173, 175, or 177; a LCDR2 comprising the amino acid sequence of SEQ ID NO: 150 or 153; and a LCDR3 comprising the amino acid sequence of SEQ ID NO: 174 or 176.

In some embodiments, the antibody or antigen binding region thereof that specifically binds to human ENTPD2 comprises an HCDR1 comprising the amino acid sequence of SEQ ID NO: 160; an HCDR2 comprising the amino acid sequence of SEQ ID NO: 161; an HCDR3 comprising the amino acid sequence of SEQ ID NO: 162; an LCDR1 comprising the amino acid sequence of SEQ ID NO: 173; an LCDR2 comprising the amino acid sequence of SEQ ID NO: 150; and an LCDR3 comprising the amino acid sequence of SEQ ID NO: 174.

In some embodiments, the antibody or antigen binding region thereof that specifically binds to human ENTPD2 comprises an HCDR1 comprising the amino acid sequence of SEQ ID NO: 163; an HCDR2 comprising the amino acid sequence of SEQ ID NO: 164; an HCDR3 comprising the amino acid sequence of SEQ ID NO: 162; an LCDR1 comprising the amino acid sequence of SEQ ID NO: 175; an LCDR2 comprising the amino acid sequence of SEQ ID NO: 153; and an LCDR3 comprising the amino acid sequence of SEQ ID NO: 176.

In some embodiments, the antibody or antigen binding region thereof that specifically binds to human ENTPD2 comprises an HCDR1 comprising the amino acid sequence of SEQ ID NO: 165; an HCDR2 comprising the amino acid sequence of SEQ ID NO: 161; an HCDR3 comprising the amino acid sequence of SEQ ID NO: 162; an LCDR1 comprising the amino acid sequence of SEQ ID NO: 173; an LCDR2 comprising the amino acid sequence of SEQ ID NO: 150; and an LCDR3 comprising the amino acid sequence of SEQ ID NO: 174.

In some embodiments, the antibody or antigen binding region thereof that specifically binds to human ENTPD2 comprises an HCDR1 comprising the amino acid sequence of SEQ ID NO: 166; an HCDR2 comprising the amino acid sequence of SEQ ID NO: 167; an HCDR3 comprising the amino acid sequence of SEQ ID NO: 168; an LCDR1 comprising the amino acid sequence of SEQ ID NO: 177; an LCDR2 comprising the amino acid sequence of SEQ ID NO: 153; and an LCDR3 comprising the amino acid sequence of SEQ ID NO: 174.

In some embodiments, the antibody or antigen binding region thereof that specifically binds to human ENTPD2 comprises a HCDR1 comprising the amino acid sequence of SEQ ID NO: 37, 40, 42, or 43; a HCDR2 comprising the amino acid sequence of SEQ ID NO: 220, 222, or 223; a HCDR3 comprising the amino acid sequence of SEQ ID NO: 221 or 224; a LCDR1 comprising the amino acid sequence of SEQ ID NO: 61, 62, or 63; a LCDR2 comprising the amino acid sequence of SEQ ID NO: 51 or 54; and a LCDR3 comprising the amino acid sequence of SEQ ID NO: 52 or 55.

In some embodiments, the antibody or antigen binding region thereof that specifically binds to human ENTPD2 comprises an HCDR1 comprising the amino acid sequence of SEQ ID NO: 37; an HCDR2 comprising the amino acid sequence of SEQ ID NO: 220; an HCDR3 comprising the amino acid sequence of SEQ ID NO: 221; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 40; an HCDR2 comprising the amino acid sequence of SEQ ID NO: 222; an HCDR3 comprising the amino acid sequence of SEQ ID NO: 221; an LCDR1 comprising the amino acid sequence of SEQ ID NO: 62; an LCDR2 comprising the amino acid sequence of SEQ ID NO: 54; and an LCDR3 comprising the amino acid sequence of SEQ ID NO: 55.

In some embodiments, the antibody or antigen binding region thereof that specifically binds to human ENTPD2 comprises an HCDR1 comprising the amino acid sequence of SEQ ID NO: 42; an HCDR2 comprising the amino acid sequence of SEQ ID NO: 220; an HCDR3 comprising the amino acid sequence of SEQ ID NO: 221; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 43; an HCDR2 comprising the amino acid sequence of SEQ ID NO: 223; an HCDR3 comprising the amino acid sequence of SEQ ID NO: 224; an LCDR1 comprising the amino acid sequence of SEQ ID NO: 63; an LCDR2 comprising the amino acid sequence of SEQ ID NO: 54; and an LCDR3 comprising the amino acid sequence of SEQ ID NO: 52.

In some embodiments, the antibody or antigen binding region thereof that specifically binds to human ENTPD2 comprises a HCDR1 comprising the amino acid sequence of SEQ ID NO: 37, 40, 42 or 43; a HCDR2 comprising the amino acid sequence of SEQ ID NO: 220, 222, or 223; a HCDR3 comprising the amino acid sequence of SEQ ID NO: 68 or 69; a LCDR1 comprising the amino acid sequence of SEQ ID NO: 61, 62, or 63; a LCDR2 comprising the amino acid sequence of SEQ ID NO: 51 or 54; and a LCDR3 comprising the amino acid sequence of SEQ ID NO: 52 or 55.

In some embodiments, the antibody or antigen binding region thereof that specifically binds to human ENTPD2 comprises an HCDR1 comprising the amino acid sequence of SEQ ID NO: 37; an HCDR2 comprising the amino acid sequence of SEQ ID NO: 220; an HCDR3 comprising the amino acid sequence of SEQ ID NO: 68; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 40; an HCDR2 comprising the amino acid sequence of SEQ ID NO: 222; an HCDR3 comprising the amino acid sequence of SEQ ID NO: 68; an LCDR1 comprising the amino acid sequence of SEQ ID NO: 62; an LCDR2 comprising the amino acid sequence of SEQ ID NO: 54; and an LCDR3 comprising the amino acid sequence of SEQ ID NO: 55.

In some embodiments, the antibody or antigen binding region thereof that specifically binds to human ENTPD2 comprises an HCDR1 comprising the amino acid sequence of SEQ ID NO: 42; an HCDR2 comprising the amino acid sequence of SEQ ID NO: 220; an HCDR3 comprising the amino acid sequence of SEQ ID NO: 68; an LCDR1 comprising the amino acid sequence of SEQ ID NO: 61; an LCDR2 comprising the amino acid sequence of SEQ ID NO: 51; and an LCDR3 comprising the amino acid sequence of SEQ ID NO: 52.

In some embodiments, the antibody or antigen binding region thereof that specifically binds to human ENTPD2 comprises an HCDR1 comprising the amino acid sequence of SEQ ID NO: 43; an HCDR2 comprising the amino acid sequence of SEQ ID NO: 223; an HCDR3 comprising the amino acid sequence of SEQ ID NO: 69; an LCDR1 comprising the amino acid sequence of SEQ ID NO: 63; an LCDR2 comprising the amino acid sequence of SEQ ID NO: 54; and an LCDR3 comprising the amino acid sequence of SEQ ID NO: 52.

In some embodiments, the antibody or antigen binding region thereof that specifically binds to human ENTPD2 comprises a HCDR1 comprising the amino acid sequence of SEQ ID NO: 1, 4, 6, or 7; a HCDR2 comprising the amino acid sequence of SEQ ID NO: 245, 247, or 248; a HCDR3 comprising the amino acid sequence of SEQ ID NO: 246 or 249; a LCDR1 comprising the amino acid sequence of SEQ ID NO: 17, 20, or 254; a LCDR2 comprising the amino acid sequence of SEQ ID NO: 15 or 18; and a LCDR3 comprising the amino acid sequence of SEQ ID NO: 255 or 256.

In some embodiments, the antibody or antigen binding region thereof that specifically binds to human ENTPD2 comprises an HCDR1 comprising the amino acid sequence of SEQ ID NO: 1; an HCDR2 comprising the amino acid sequence of SEQ ID NO: 245; an HCDR3 comprising the amino acid sequence of SEQ ID NO: 246; an LCDR1 comprising the amino acid sequence of SEQ ID NO: 254; an LCDR2 comprising the amino acid sequence of SEQ ID NO: 15; and an LCDR3 comprising the amino acid sequence of SEQ ID NO: 255.

In some embodiments, the antibody or antigen binding region thereof that specifically binds to human ENTPD2 comprises an HCDR1 comprising the amino acid sequence of SEQ ID NO: 4; an HCDR2 comprising the amino acid sequence of SEQ ID NO: 247; an HCDR3 comprising the amino acid sequence of SEQ ID NO: 246; an LCDR1 comprising the amino acid sequence of SEQ ID NO: 17; an LCDR2 comprising the amino acid sequence of SEQ ID NO: 18; and an LCDR3 comprising the amino acid sequence of SEQ ID NO: 256.

In some embodiments, the antibody or antigen binding region thereof that specifically binds to human ENTPD2 comprises an HCDR1 comprising the amino acid sequence of SEQ ID NO: 6; an HCDR2 comprising the amino acid sequence of SEQ ID NO: 254; an HCDR3 comprising the amino acid sequence of SEQ ID NO: 246; an LCDR1 comprising the amino acid sequence of SEQ ID NO: 254; an LCDR2 comprising the amino acid sequence of SEQ ID NO: 15; and an LCDR3 comprising the amino acid sequence of SEQ ID NO: 255.

In some embodiments, the antibody or antigen binding region thereof that specifically binds to human ENTPD2 comprises an HCDR1 comprising the amino acid sequence of SEQ ID NO: 7; an HCDR2 comprising the amino acid sequence of SEQ ID NO: 248; an HCDR3 comprising the amino acid sequence of SEQ ID NO: 249; an LCDR1 comprising the amino acid sequence of SEQ ID NO: 20; an LCDR2 comprising the amino acid sequence of SEQ ID NO: 18; and an LCDR3 comprising the amino acid sequence of SEQ ID NO: 255.

In some embodiments, the antibody or antigen binding region thereof that specifically binds to human ENTPD2 comprises a HCDR1 comprising the amino acid sequence of SEQ ID NO: 1, 4, 6, or 7; a HCDR2 comprising the amino acid sequence of SEQ ID NO: 247, 248, or 261; a HCDR3 comprising the amino acid sequence of SEQ ID NO: 262 or 263; a LCDR1 comprising the amino acid sequence of SEQ ID NO: 17, 20, or 254; a LCDR2 comprising the amino acid sequence of SEQ ID NO: 15 or 18; and a LCDR3 comprising the amino acid sequence of SEQ ID NO: 16 or 19.

In some embodiments, the antibody or antigen binding region thereof that specifically binds to human ENTPD2 comprises an HCDR1 comprising the amino acid sequence of SEQ ID NO: 1; an HCDR2 comprising the amino acid sequence of SEQ ID NO: 261; an HCDR3 comprising the amino acid sequence of SEQ ID NO: 262; an LCDR1 comprising the amino acid sequence of SEQ ID NO: 254; an LCDR2 comprising the amino acid sequence of SEQ ID NO: 15; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 4; an HCDR2 comprising the amino acid sequence of SEQ ID NO: 247; an HCDR3 comprising the amino acid sequence of SEQ ID NO: 262; an LCDR1 comprising the amino acid sequence of SEQ ID NO: 17; an LCDR2 comprising the amino acid sequence of SEQ ID NO: 18; and an LCDR3 comprising the amino acid sequence of SEQ ID NO: 19.

In some embodiments, the antibody or antigen binding region thereof that specifically binds to human ENTPD2 comprises an HCDR1 comprising the amino acid sequence of SEQ ID NO: 6; an HCDR2 comprising the amino acid sequence of SEQ ID NO: 261; an HCDR3 comprising the amino acid sequence of SEQ ID NO: 262; an LCDR1 comprising the amino acid sequence of SEQ ID NO: 254; an LCDR2 comprising the amino acid sequence of SEQ ID NO: 15; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 7; an HCDR2 comprising the amino acid sequence of SEQ ID NO: 248; an HCDR3 comprising the amino acid sequence of SEQ ID NO: 263; an LCDR1 comprising the amino acid sequence of SEQ ID NO: 20; an LCDR2 comprising the amino acid sequence of SEQ ID NO: 18; and an LCDR3 comprising the amino acid sequence of SEQ ID NO: 16.

In some embodiments, the antibody or antigen binding region thereof that specifically binds to human ENTPD2 comprises a HCDR1 comprising the amino acid sequence of SEQ ID NO: 272, 275, or 278; a HCDR2 comprising the amino acid sequence of SEQ ID NO: 273, 276, or 279; a HCDR3 comprising the amino acid sequence of SEQ ID NO: 274, 277, or 280; a LCDR1 comprising the amino acid sequence of SEQ ID NO: 17, 20, or 254; a LCDR2 comprising the amino acid sequence of SEQ ID NO: 285 or 286; and a LCDR3 comprising the amino acid sequence of SEQ ID NO: 16 or 19.

In some embodiments, the antibody or antigen binding region thereof that specifically binds to human ENTPD2 comprises an HCDR1 comprising the amino acid sequence of SEQ ID NO: 272; an HCDR2 comprising the amino acid sequence of SEQ ID NO: 273; an HCDR3 comprising the amino acid sequence of SEQ ID NO: 274; an LCDR1 comprising the amino acid sequence of SEQ ID NO: 254; an LCDR2 comprising the amino acid sequence of SEQ ID NO: 285; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 275; an HCDR2 comprising the amino acid sequence of SEQ ID NO: 276; an HCDR3 comprising the amino acid sequence of SEQ ID NO: 274; an LCDR1 comprising the amino acid sequence of SEQ ID NO: 17; an LCDR2 comprising the amino acid sequence of SEQ ID NO: 286; and an LCDR3 comprising the amino acid sequence of SEQ ID NO: 19.

In some embodiments, the antibody or antigen binding region thereof that specifically binds to human ENTPD2 comprises an HCDR1 comprising the amino acid sequence of SEQ ID NO: 277; an HCDR2 comprising the amino acid sequence of SEQ ID NO: 273; an HCDR3 comprising the amino acid sequence of SEQ ID NO: 274; an LCDR1 comprising the amino acid sequence of SEQ ID NO: 254; an LCDR2 comprising the amino acid sequence of SEQ ID NO: 285; and an LCDR3 comprising the amino acid sequence of SEQ ID NO: 16.

In some embodiments, the antibody or antigen binding region thereof that specifically binds to human ENTPD2 comprises an HCDR1 comprising the amino acid sequence of SEQ ID NO: 278; an HCDR2 comprising the amino acid sequence of SEQ ID NO: 279; an HCDR3 comprising the amino acid sequence of SEQ ID NO: 280; an LCDR1 comprising the amino acid sequence of SEQ ID NO: 20; an LCDR2 comprising the amino acid sequence of SEQ ID NO: 286; and an LCDR3 comprising the amino acid sequence of SEQ ID NO: 16.

In some embodiments, the antibody or antigen binding region thereof that specifically binds to human ENTPD2 comprises a heavy chain variable region (VH) comprising the amino acid sequence of SEQ ID NO: 10 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 21 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 25 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 29 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 33 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 29 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 46 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 57 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 46 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 64 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 70 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 74 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 25 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 78 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 91 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 102 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 115 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 125 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 132 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 125 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 145 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 156 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 169 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 178 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 225 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 229 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 233 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 237 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 241 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 229 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 250 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 257 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 264 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 268 (or a sequence at least about 90%, 95%, 99% or more identical thereto, and/or having one, two, three or more substitutions, insertions, deletions, or modifications).

In some embodiments, the antibody or antigen binding region thereof that specifically binds to human ENTPD2 comprises a heavy chain variable region (VH) comprising the amino acid sequence of SEQ ID NO: 281 (or a sequence at least about 90%, 95%, 99% or more identical thereto, and/or having one, two, three or more substitutions, insertions, deletions, or modifications), and a light chain variable region (VL) comprising the amino acid sequence of SEQ ID NO: 287 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 12 (or a sequence at least about 90%, 95%, 99% or more identical thereto, and/or having one, two, three or more substitutions, insertions, deletions, or modifications), and a light chain comprising the amino acid sequence of SEQ ID NO: 23 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 27 (or a sequence at least about 90%, 95%, 99% or more identical thereto, and/or having one, two, three or more substitutions, insertions, deletions, or modifications), and a light chain comprising the amino acid sequence of SEQ ID NO: 31 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 35 (or a sequence at least about 90%, 95%, 99% or more identical thereto, and/or having one, two, three or more substitutions, insertions, deletions, or modifications), and a light chain comprising the amino acid sequence of SEQ ID NO: 31 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 48 (or a sequence at least about 90%, 95%, 99% or more identical thereto, and/or having one, two, three or more substitutions, insertions, deletions, or modifications), and a light chain comprising the amino acid sequence of SEQ ID NO: 59 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 48 (or a sequence at least about 90%, 95%, 99% or more identical thereto, and/or having one, two, three or more substitutions, insertions, deletions, or modifications), and a light chain comprising the amino acid sequence of SEQ ID NO: 66 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 72 (or a sequence at least about 90%, 95%, 99% or more identical thereto, and/or having one, two, three or more substitutions, insertions, deletions, or modifications), and a light chain comprising the amino acid sequence of SEQ ID NO: 76 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 27 (or a sequence at least about 90%, 95%, 99% or more identical thereto, and/or having one, two, three or more substitutions, insertions, deletions, or modifications), and a light chain comprising the amino acid sequence of SEQ ID NO: 80 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 93 (or a sequence at least about 90%, 95%, 99% or more identical thereto, and/or having one, two, three or more substitutions, insertions, deletions, or modifications), and a light chain comprising the amino acid sequence of SEQ ID NO: 104 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 117 (or a sequence at least about 90%, 95%, 99% or more identical thereto, and/or having one, two, three or more substitutions, insertions, deletions, or modifications), and a light chain comprising the amino acid sequence of SEQ ID NO: 127 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 134 (or a sequence at least about 90%, 95%, 99% or more identical thereto, and/or having one, two, three or more substitutions, insertions, deletions, or modifications), and a light chain comprising the amino acid sequence of SEQ ID NO: 127 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 147 (or a sequence at least about 90%, 95%, 99% or more identical thereto, and/or having one, two, three or more substitutions, insertions, deletions, or modifications), and a light chain comprising the amino acid sequence of SEQ ID NO: 158 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 171 (or a sequence at least about 90%, 95%, 99% or more identical thereto, and/or having one, two, three or more substitutions, insertions, deletions, or modifications), and a light chain comprising SEQ ID NO: 180 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 227 (or a sequence at least about 90%, 95%, 99% or more identical thereto, and/or having one, two, three or more substitutions, insertions, deletions, or modifications), and a light chain comprising the amino acid sequence of SEQ ID NO: 231 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 235 (or a sequence at least about 90%, 95%, 99% or more identical thereto, and/or having one, two, three or more substitutions, insertions, deletions, or modifications), and a light chain comprising the amino acid sequence of SEQ ID NO: 239 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 243 (or a sequence at least about 90%, 95%, 99% or more identical thereto, and/or having one, two, three or more substitutions, insertions, deletions, or modifications), and a light chain comprising the amino acid sequence of SEQ ID NO: 231 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 252 (or a sequence at least about 90%, 95%, 99% or more identical thereto, and/or having one, two, three or more substitutions, insertions, deletions, or modifications), and a light chain comprising the amino acid sequence of SEQ ID NO: 259 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 266 (or a sequence at least about 90%, 95%, 99% or more identical thereto, and/or having one, two, three or more substitutions, insertions, deletions, or modifications), and a light chain comprising the amino acid sequence of SEQ ID NO: 270 (or a sequence at least about 90%, 95%, 99% or more identical thereto, and/or having one, two, three or more substitutions, insertions, deletions, or modifications).

In some embodiments, the antibody that specifically binds to human ENTPD2 comprises a heavy chain comprising the amino acid sequence of SEQ ID NO: 283 (or a sequence at least about 90%, 95%, 99% or more identical thereto, and/or having one, two, three or more substitutions, insertions, deletions, or modifications), and a light chain comprising the amino acid sequence of SEQ ID NO: 289 (or a sequence at least about 90%, 95%, 99% or more identical thereto, and/or having one, two, three or more substitutions, insertions, deletions, or modifications).

In some embodiments, the present invention provides an antibody or antigen-binding fragment thereof, which bind to human ENTPD2 protein with a dissociation constant ($K_D$) of less than 10 nM, e.g., a $K_D$ of less than 9 nM, less than 8 nM, less than 7 nM, less than 6 nM, less than 5 nM, less than 4 nM, less than 3 nM, less than 2 nM, less than 1 nM, e.g., as measured by Biacore™. In some embodiments, the antibodies or antigen-binding fragments provided herein bind to human ENTPD2 protein with a dissociation constant ($K_D$) of less than 5 nM, e.g., as measured by Biacore™. In some embodiments, the antibodies or antigen-binding fragments provided herein bind to human ENTPD2 protein with a dissociation constant ($K_D$) of less than 3 nM, e.g., as measured by Biacore™. In some embodiments, the antibodies or antigen-binding fragments provided herein bind to human ENTPD2 protein with a dissociation constant ($K_D$) of less than 1 nM, e.g., as measured by Biacore™. In some embodiments, the dissociation constant of the antibodies or antigen binding fragments thereof described herein to human ENTPD2 is measured by Biacore™ at 25° C.

Provided herein are also antibodies or antigen binding fragments thereof that specifically bind to an epitope in human ENTPD2, wherein the epitope comprises at least one (e.g., at least two, at least three, at least four, at least five, at least six, at least seven, at least eight, at least nine, at least ten, at least eleven, at least twelve, at least thirteen, at least fourteen, at least fifteen, at least twenty) of the following residues: His50, Asp76, Pro78, Gly79, Gly80, Tyr85, Asp87, Asn88, Gly91, Gln94, Ser95, Gly98, Glu101, Gln102, Gln105, Asp106, Arg245, Thr272, Gln273, Leu275, Asp278, Arg298, Ala347, Ala350, Thr351, Arg392, Ala393, Arg394, or Tyr398. In some embodiments, such antibodies or antigen binding fragments include, but are not limited to, MAb1, MAb2, MAb3, MAb7, MAb17, MAb19, MAb20, MAb21, and Fab23 as disclosed in Table 1.

Provided herein are also antibodies or antigen binding fragments thereof that specifically bind to an epitope in human ENTPD2, wherein the epitope comprises at least one (e.g., at least two, at least three, at least four, at least five, at least six, at least seven, at least eight, at least nine, at least ten, at least eleven, at least twelve, at least thirteen, at least fourteen, at least fifteen, at least twenty) of the following residues: Gly79, Gln250, Leu253, Trp266, Arg268, Gly269, Phe270, Ser271, Thr272, Gln273, Val274, Leu275, Asp278, Arg298, Ser300, Ser302, Gly303, Thr380, Trp381, Ala382, Gly390, Gln391, Arg392, Ala393, Arg394, or Asp397. In some embodiments, such antibodies or antigen binding fragments include, but are not limited to, MAb4, MAb5, MAb6, MAb16, MAb18, and Fab22 as disclosed in Table 1.

Once a desired epitope on an antigen is determined, it is possible to generate antibodies to that epitope, e.g., using the techniques described in the present invention. Alternatively, during the discovery process, the generation and characterization of antibodies may elucidate information about desirable epitopes. From this information, it is then possible to competitively screen antibodies for binding to the same epitope. An approach to achieve this is to conduct cross-competition studies to find antibodies that competitively bind with one another, e.g., the antibodies compete for binding to the antigen. A high throughput process for "binning" antibodies based upon their cross-competition is described in International Patent Application No. WO 2003/48731. As will be appreciated by one of skill in the art, practically anything to which an antibody can specifically bind could be an epitope. An epitope can comprises those residues to which the antibody binds.

Generally, antibodies specific for a particular target antigen will preferentially recognize an epitope on the target antigen in a complex mixture of proteins and/or macromolecules.

Regions of a given polypeptide that include an epitope can be identified using any number of epitope mapping techniques, well known in the art. See, e.g., Epitope Mapping Protocols in Methods in Molecular Biology, Vol. 66 (Glenn E. Morris, Ed., 1996, Humana Press, Totowa, N.J). For example, linear epitopes may be determined by e.g., concurrently synthesizing large numbers of peptides on solid supports, the peptides corresponding to portions of the protein molecule, and reacting the peptides with antibodies while the peptides are still attached to the supports. Such techniques are known in the art and described in, e.g., U.S. Pat. No. 4,708,871; Geysen et al., (1984) Proc. Natl. Acad. Sci. USA 8:3998-4002; Geysen et al., (1985) Proc. Natl. Acad. Sci. USA 82:78-182; Geysen et al., (1986) Mol. Immunol. 23:709-715. Similarly, conformational epitopes are readily identified by determining spatial conformation of amino acids such as by, e.g., x-ray crystallography and two-dimensional nuclear magnetic resonance. See, e.g., Epitope Mapping Protocols, supra. Antigenic regions of proteins can also be identified using standard antigenicity and hydropathy plots, such as those calculated using, e.g., the Omiga version 1.0 software program available from the Oxford Molecular Group. This computer program employs the Hopp/Woods method, Hopp et al., (1981) Proc. Natl. Acad. Sci USA 78:3824-3828; for determining antigenicity profiles, and the Kyte-Doolittle technique, Kyte et al., (1982) J. Mol. Biol. 157:105-132; for hydropathy plots.

The antibody molecule can be a polyclonal or a monoclonal antibody. A monoclonal antibody can be made by hybridoma technology or by methods that do not use hybridoma technology (e.g., recombinant methods). In some embodiments, the antibody can be recombinantly produced, e.g., produced by phage display or by combinatorial methods.

Phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) Bio/Technology 9:1370-1372; Hay et al. (1992) Hum Antibod Hybridomas 3:81-85; Huse et al. (1989) Science 246:1275-1281; Griffths et al. (1993) EMBO J 12:725-734; Hawkins et al. (1992) J Mol Biol 226:889-896; Clackson et al. (1991) Nature 352:624-628; Gram et al. (1992) PNAS 89:3576-3580; Garrad et al. (1991) Bio/Technology 9:1373-1377;

Hoogenboom et al. (1991) Nuc Acid Res 19:4133-4137; and Barbas et al. (1991) PNAS 88:7978-7982).

In one embodiment, the antibody is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody.

An antibody can be one in which the variable region, or a portion thereof, e.g., the CDRs, are generated in a non-human organism, e.g., a rat or mouse. Chimeric, CDR-grafted, and humanized antibodies are within the invention. Antibodies generated in a non-human organism, e.g., a rat or mouse, and then modified, e.g., in the variable framework or constant region, to decrease antigenicity in a human are within the invention.

Chimeric and/or humanized antibodies, can be engineered to minimize the immune response by a human patient to antibodies produced in non-human subjects or derived from the expression of non-human antibody genes. Chimeric antibodies comprise a non-human animal antibody variable region and a human antibody constant region. Such antibodies retain the epitope binding specificity of the original monoclonal antibody, but may be less immunogenic when administered to humans, and therefore more likely to be tolerated by the patient. For example, one or all (e.g., one, two, or three) of the variable regions of the light chain(s) and/or one or all (e.g., one, two, or three) of the variable regions the heavy chain(s) of a mouse antibody (e.g., a mouse monoclonal antibody) can each be joined to a human constant region, such as, without limitation an IgG1 human constant region. Chimeric monoclonal antibodies can be produced by recombinant DNA techniques known in the art. For example, a gene encoding the constant region of a non-human antibody molecule can be substituted with a gene encoding a human constant region (see Robinson et al., PCT Patent Publication PCT/US86/02269; Akira, et al., European Patent Application 184,187; or Taniguchi, M., European Patent Application 171,496). In addition, other suitable techniques that can be used to generate chimeric antibodies are described, for example, in U.S. Pat. Nos. 4,816,567; 4,978,775; 4,975,369; and 4,816,397.

A chimeric antibody can be further "humanized" by replacing portions of the variable region not involved in antigen binding with equivalent portions from human variable regions. Humanized antibodies comprise one or more human framework regions in the variable region together with non-human (e.g., mouse, rat, or hamster) complementarity-determining regions (CDRs) of the heavy and/or light chain. In some embodiments, a humanized antibody comprises sequences that are entirely human except for the CDR regions. Humanized antibodies are typically less immunogenic to humans, relative to non-humanized antibodies, and thus offer therapeutic benefits in certain situations. Humanized ENTPD2 antibodies can be generated using methods known in the art. See for example, Hwang et al., Methods 36:35, 2005; Queen et al., Proc. Natl. Acad. Sci. U.S.A. 86:10029-10033, 1989; Jones et al., Nature 321:522-25, 1986; Riechmann et al., Nature 332:323-27, 1988; Verhoeyen et al., Science 239:1534-36, 1988; Orlandi et al., Proc. Natl. Acad. Sci. U.S.A. 86:3833-3837, 1989; U.S. Pat. Nos. 5,225,539; 5,530,101; 5,585,089; 5,693,761; 5,693,762; and 6,180,370; and WO 90/07861.

Human ENTPD2 antibodies can be generated using methods that are known in the art. For example, the humaneering technology used to converting non-human antibodies into engineered human antibodies. U.S. Patent Publication No. 20050008625 describes an in vivo method for replacing a nonhuman antibody variable region with a human variable region in an antibody while maintaining the same or providing better binding characteristics relative to that of the nonhuman antibody. The method relies on epitope guided replacement of variable regions of a non-human reference antibody with a fully human antibody. The resulting human antibody is generally structurally unrelated to the reference nonhuman antibody, but binds to the same epitope on the same antigen as the reference antibody. Briefly, the serial epitope-guided complementarity replacement approach is enabled by setting up a competition in cells between a "competitor" and a library of diverse hybrids of the reference antibody ("test antibodies") for binding to limiting amounts of antigen in the presence of a reporter system which responds to the binding of test antibody to antigen. The competitor can be the reference antibody or derivative thereof such as a single-chain Fv fragment. The competitor can also be a natural or artificial ligand of the antigen which binds to the same epitope as the reference antibody. The only requirements of the competitor are that it binds to the same epitope as the reference antibody, and that it competes with the reference antibody for antigen binding. The test antibodies have one antigen-binding V-region in common from the nonhuman reference antibody, and the other V-region selected at random from a diverse source such as a repertoire library of human antibodies. The common V-region from the reference antibody serves as a guide, positioning the test antibodies on the same epitope on the antigen, and in the same orientation, so that selection is biased toward the highest antigen-binding fidelity to the reference antibody.

Many types of reporter system can be used to detect desired interactions between test antibodies and antigen. For example, complementing reporter fragments may be linked to antigen and test antibody, respectively, so that reporter activation by fragment complementation only occurs when the test antibody binds to the antigen. When the test antibody- and antigen-reporter fragment fusions are co-expressed with a competitor, reporter activation becomes dependent on the ability of the test antibody to compete with the competitor, which is proportional to the affinity of the test antibody for the antigen. Other reporter systems that can be used include the reactivator of an auto-inhibited reporter reactivation system (RAIR) as disclosed in U.S. patent application Ser. No. 10/208,730 (Publication No. 20030198971), or competitive activation system disclosed in U.S. patent application Ser. No. 10/076,845 (Publication No. 20030157579).

With the serial epitope-guided complementarity replacement system, selection is made to identify cells expresses a single test antibody along with the competitor, antigen, and reporter components. In these cells, each test antibody competes one-on-one with the competitor for binding to a limiting amount of antigen. Activity of the reporter is proportional to the amount of antigen bound to the test antibody, which in turn is proportional to the affinity of the test antibody for the antigen and the stability of the test antibody. Test antibodies are initially selected on the basis of their activity relative to that of the reference antibody when expressed as the test antibody. The result of the first round of selection is a set of "hybrid" antibodies, each of which is comprised of the same non-human V-region from the reference antibody and a human V-region from the library, and each of which binds to the same epitope on the antigen as the reference antibody. One of more of the hybrid antibodies selected in the first round will have an affinity for the antigen comparable to or higher than that of the reference antibody.

In the second V-region replacement step, the human V-regions selected in the first step are used as guide for the selection of human replacements for the remaining non-human reference antibody V-region with a diverse library of cognate human V-regions. The hybrid antibodies selected in the first round may also be used as competitors for the second round of selection. The result of the second round of selection is a set of fully human antibodies which differ structurally from the reference antibody, but which compete with the reference antibody for binding to the same antigen. Some of the selected human antibodies bind to the same epitope on the same antigen as the reference antibody. Among these selected human antibodies, one or more binds to the same epitope with an affinity which is comparable to or higher than that of the reference antibody.

Using a mouse or chimeric ENTPD2 antibody, human antibodies that bind to human ENTPD2 with the same binding specificity and the same or better binding affinity can be generated. In addition, such human ENTPD2 antibodies can also be commercially obtained from companies which customarily produce human antibodies, e.g., KaloBios, Inc. (Mountain View, Calif.).

In some embodiments, the present invention provides an antibody or antigen-binding fragment thereof that bind to human ENTPD2 protein and modulates one or more ENTPD2 activities/functions, e.g., inhibiting the enzymatic activities of human ENTPD2, e.g., by at least 40%, at least 50%, at least 60%, at least 70%, at least 80%, or at least 90%. In some embodiments, the enzymatic activity of human ENTPD2 is measured using an in vitro FRET assay which measures the hydrolysis of ATP to ADP by either recombinant ENTPD2 or ENTPD2 expressed on the surface of cells.

In some embodiments, the anti-human ENTPD2 antibodies or antigen binding fragments thereof described herein inhibit ENTPD2's ability of hydrolysis of adenosine triphosphate (ATP). In some embodiments, ENTPD2's ability of hydrolysis of ATP is measured using an in vitro FRET assay which measures the hydrolysis of ATP to ADP by either recombinant ENTPD2 or ENTPD2 expressed on the surface of cells.

In some embodiments, the anti-human ENTPD2 antibodies or antigen binding fragments thereof described herein interfere with ATP binding to ENTPD2 or trap ATP within the catalytic domain of ENTPD2. In some embodiments, interference with ATP binding to ENTPD2 or trapping ATP within the catalytic domain of ENTPD2 is measured using an in vitro FRET assay which measures the hydrolysis of ATP to ADP by either recombinant ENTPD2 or ENTPD2 expressed on the surface of cells.

Antibodies and Antigen-Binding Fragments Thereof that Specifically Bind to Mouse ENTPD2

Also provided herein are antibodies or antigen binding fragments thereof, e.g., monoclonal antibodies or antigen binding fragments thereof, that specifically bind to mouse ENTPD2 protein. Table 26 lists the sequences of exemplary the ENTPD2 antibodies or antigen-binding fragments that specifically bind to mouse ENTPD2 protein.

TABLE 26

Sequences of Exemplary Monoclonal Antibodies (MABs) and Antibody Fragments (FABs) That Bind Mouse ENTPD2

ANTI-mouse ENTPD2 MAB13

| | | |
|---|---|---|
| SEQ ID NO: 182 | HCDR1 (KABAT) | HYGMN |
| SEQ ID NO: 183 | HCDR2 (KABAT) | WINTDTGNPTYADDFKG |
| SEQ ID NO: 184 | HCDR3 (KABAT) | YGTLYSGYGFFFDS |
| SEQ ID NO: 185 | HCDR1 (CHOTHIA) | GYTFTHY |
| SEQ ID NO: 186 | HCDR2 (CHOTHIA) | NTDTGN |
| SEQ ID NO: 184 | HCDR3 (CHOTHIA) | YGTLYSGYGFFFDS |
| SEQ ID NO: 187 | HCDR1 (COMBINED) | GYTFTHYGMN |
| SEQ ID NO: 183 | HCDR2 (COMBINED) | WINTDTGNPTYADDFKG |
| SEQ ID NO: 184 | HCDR3 (COMBINED) | YGTLYSGYGFFFDS |
| SEQ ID NO: 188 | HCDR1 (IMGT) | GYTFTHYG |
| SEQ ID NO: 189 | HCDR2 (IMGT) | INTDTGNP |
| SEQ ID NO: 190 | HCDR3 (IMGT) | VRYGTLYSGYGFFFDS |
| SEQ ID NO: 191 | VH | QVQLVQSGAELKQPGQSVKISCKASGYTFTHYGMN WVKQAPGQGLKWMGWINTDTGNPTYADDFKGRFV FSLDTSVSTAYLQISNLKNEDTATYYCVRYGTLYSGY GFFFDSWGQGTLVTVSS |
| SEQ ID NO: 192 | VH DNA | CAGGTCCAGCTGGTGCAGTCAGGAGCTGAGCTGA AGCAGCCTGGACAGTCGGTGAAGATCTCCTGCAAG GCTTCAGGGTACACCTTCACACACTATGGGATGAA CTGGGTGAAGCAGGCACCAGGACAGGGTCTAAAG TGGATGGGCTGGATCAACACTGACACTGGGAATCC |

TABLE 26-continued

Sequences of Exemplary Monoclonal Antibodies (MABs) and
Antibody Fragments (FABs) That Bind Mouse ENTPD2

| | | |
|---|---|---|
| | | AACATATGCTGATGACTTCAAAGGACGGTTTGTCT<br>TCTCCTTGGACACCTCTGTCAGCACTGCATATCTGC<br>AGATCAGCAACCTCAAGAATGAAGACACGGCCAC<br>GTATTACTGTGTGAGATATGGAACCCTATATAGCG<br>GATATGGGTTTTTTTTTGATTCCTGGGGCCAAGGG<br>ACCCTGGTCACCGTCTCCTCA |
| SEQ ID NO: 193 | HC | QVQLVQSGAELKQPGQSVKISCKASGYTFTHYGMN<br>WVKQAPGQGLKWMGWINTDTGNPTYADDFKGRFV<br>FSLDTSVSTAYLQISNLKNEDTATYYCVRYGTLYSGY<br>GFFFDSWGQGTLVTVSSAKTTAPSVYPLAPVCGDTT<br>GSSVTLGCLVKGYFPEPVTLTWNSGSLSSGVHTFPAV<br>LQSDLYTLSSSVTVTSSTWPSQSITCNVAHPASSTKV<br>DKKIEPRGPTIKPCPPCKCPAPNLLGGPSVFIFPPKIKD<br>VLMISLSPIVTCVVVDVSEDDPDVQISWFVNNVEVHT<br>AQTQTHREDYNSTLRVVSALPIQHQDWMSGKEFKC<br>KVNNKDLPAPIERTISKPKGSVRAPQVYVLPPPEEEM<br>TKKQVTLTCMVTDFMPEDIYVEWTNNGKTELNYKN<br>TEPVLDSDGSYFMYSKLRVEKKNWVERNSYSCSVV<br>HEGLHNHHTTKSFSRTPGK |
| SEQ ID NO: 194 | HC DNA | CAGGTCCAGCTGGTGCAGTCAGGAGCTGAGCTGA<br>AGCAGCCTGGACAGTCGGTGAAGATCTCCTGCAAG<br>GCTTCAGGGTACACCTTCACACACTATGGGATGAA<br>CTGGGTGAAGCAGGCACCAGGACAGGGTCTAAAG<br>TGGATGGGCTGGATCAACACTGACACTGGGAATCC<br>AACATATGCTGATGACTTCAAAGGACGGTTTGTCT<br>TCTCCTTGGACACCTCTGTCAGCACTGCATATCTGC<br>AGATCAGCAACCTCAAGAATGAAGACACGGCCAC<br>GTATTACTGTGTGAGATATGGAACCCTATATAGCG<br>GATATGGGTTTTTTTTTGATTCCTGGGGCCAAGGG<br>ACCCTGGTCACCGTCTCCTCAGCCAAGACCACCGC<br>CCCCAGCGTGTACCCCCTGGCCCCCGTGTGCGGCG<br>ATACCACCGGCAGCAGCGTGACCCTGGGCTGCCTG<br>GTGAAGGGCTACTTCCCCGAGCCCGTGACCCTGAC<br>CTGGAACAGCGGCTCCCTGAGCAGCGGCGTGCAC<br>ACCTTCCCCGCCGTGCTGCAGAGCGACCTGTACAC<br>CCTGTCCAGCTCCGTGACCGTGACAAGCAGCACCT<br>GGCCCAGCCAGAGCATCACCTGCAACGTGGCCCAC<br>CCCGCCAGCAGCACCAAGGTGGACAAGAAGATCG<br>AGCCCAGGGGCCCCACCATCAAGCCCTGCCCCCCC<br>TGCAAGTGCCCAGCCCCCAACCTGCTGGGCGGACC<br>CAGCGTGTTCATCTTCCCCCCCAAGATCAAGGACG<br>TGCTGATGATCAGCCTGAGCCCCATCGTGACCTGC<br>GTGGTGGTGGACGTGAGCGAGGACGACCCCGACG<br>TGCAGATCAGCTGGTTCGTGAACAACGTGGAGGTG<br>CACACCGCCCAGACCCAGACCCACCGGGAGGACT<br>ACAACAGCACCCTGCGCGTCGTGTCCGCCCTGCCC<br>ATCCAGCACCAGGACTGGATGAGCGGCAAAGAAT<br>TCAAGTGCAAGGTGAACAACAAGGACCTGCCTGC<br>CCCCATCGAGCGGACCATCAGCAAGCCCAAGGGC<br>AGCGTGAGAGCCCCCAGGTGTACGTGCTGCCCCC<br>TCCCGAGGAAGAGATGACCAAGAAACAGGTGACA<br>CTGACCTGCATGGTGACCGACTTCATGCCCGAGGA<br>CATCTACGTGGAGTGGACCAACAACGGCAAGACC<br>GAGCTGAACTACAAGAACACCGAGCCTGTGCTGG<br>ACAGCGACGGCAGCTACTTCATGTACAGCAAGCTG<br>CGGGTGGAGAAGAAAAACTGGGTGGAGCGGAACA<br>GCTACAGCTGCAGCGTGGTGCACGAGGGCCTGCAC<br>AACCACCACCACCAAGAGCTTCAGCCGGACCCC<br>CGGCAAG |
| SEQ ID NO: 195 | LCDR1 (KABAT) | KSSQSLFNSNTNKNYLN |
| SEQ ID NO: 196 | LCDR2 (KABAT) | YASTRHT |
| SEQ ID NO: 197 | LCDR3 (KABAT) | QQWYSYPWT |
| SEQ ID NO: 198 | LCDR1 (CHOTHIA) | SQSLFNSNTNKNY |
| SEQ ID NO: 199 | LCDR2 (CHOTHIA) | YAS |
| SEQ ID NO: 200 | LCDR3 (CHOTHIA) | WYSYPW |
| SEQ ID NO: 195 | LCDR1 (COMBINED) | KSSQSLFNSNTNKNYLN |

TABLE 26-continued

Sequences of Exemplary Monoclonal Antibodies (MABs) and
Antibody Fragments (FABs) That Bind Mouse ENTPD2

| SEQ ID NO: 196 | LCDR2 (COMBINED) | YASTRHT |
|---|---|---|
| SEQ ID NO: 197 | LCDR3 (COMBINED) | QQWYSYPWT |
| SEQ ID NO: 201 | LCDR1 (IMGT) | QSLFNSNTNKNY |
| SEQ ID NO: 199 | LCDR2 (IMGT) | YAS |
| SEQ ID NO: 197 | LCDR3 (IMGT) | QQWYSYPWT |
| SEQ ID NO: 202 | VL | DIMMTQSPSSLSVSAGEKATITCKSSQSLFNSNTNKN YLNWYLQKPGQSPKLLFYYASTRHTGVPDRFIGSGS GTDFTLTITSVQDEDLADYYCQQWYSYPWTFGPGTK LEIK |
| SEQ ID NO: 203 | VL DNA | GACATCATGATGACCCAGTCTCCATCATCCCTGAG TGTGTCAGCAGGAGAGAAAGCCACTATCACCTGCA AGTCCAGTCAGAGTCTTTTCAACAGTAACACCAAC AAGAACTACTTGAACTGGTACCTGCAGAAACCAG GGCAGTCTCCTAAACTGCTGTTCTATTATGCATCCA CTAGGCATACTGGGGTCCCTGATCGCTTCATAGGC AGTGGATCTGGGACAGATTTCACTCTCACCATCAC CAGTGTCCAGGATGAAGACCTGGCAGATTATTACT GTCAGCAGTGGTATAGCTACCCGTGGACGTTCGGA CCTGGCACCAAGCTGGAAATCAAA |
| SEQ ID NO: 204 | LC | DIMMTQSPSSLSVSAGEKATITCKSSQSLFNSNTNKN YLNWYLQKPGQSPKLLFYYASTRHTGVPDRFIGSGS GTDFTLTITSVQDEDLADYYCQQWYSYPWTFGPGTK LEIKRADAAPTVSIFPPSSEQLTSGGASVVCFLNNFYP KDINVKWKIDGSERQNGVLNSWTDQDSKDSTYSMS STLTLTKDEYERHNSYTCEATHKTSTSPIVKSFNRNE C |
| SEQ ID NO: 205 | LC DNA | GACATCATGATGACCCAGTCTCCATCATCCCTGAG TGTGTCAGCAGGAGAGAAAGCCACTATCACCTGCA AGTCCAGTCAGAGTCTTTTCAACAGTAACACCAAC AAGAACTACTTGAACTGGTACCTGCAGAAACCAG GGCAGTCTCCTAAACTGCTGTTCTATTATGCATCCA CTAGGCATACTGGGGTCCCTGATCGCTTCATAGGC AGTGGATCTGGGACAGATTTCACTCTCACCATCAC CAGTGTCCAGGATGAAGACCTGGCAGATTATTACT GTCAGCAGTGGTATAGCTACCCGTGGACGTTCGGA CCTGGCACCAAGCTGGAAATCAAACGCGCTGATGC CGCCCCTACCGTGAGCATCTTCCCCCCCAGCAGCG AGCAGCTGACCAGCGGCGGAGCCAGCGTGGTGTG CTTCCTGAACAACTTCTACCCCAAGGACATCAACG TGAAGTGGAAGATCGACGGCAGCGAGCGGCAGAA CGGCGTGCTGAACAGCTGGACCGACCAGGACAGC AAGGACTCCACCTACAGCATGAGCAGCACCCTGAC CCTGACCAAGGACGAGTACGAGCGGCACAACAGC TACACCTGCGAGGCCACCCACAAGACCAGCACCA GCCCCATCGTGAAGAGCTTCAACCGGAACGAGTGC |

ANTI-mouse
ENTPD2 MAB14

| SEQ ID NO: 182 | HCDR1 (KABAT) | HYGMN |
|---|---|---|
| SEQ ID NO: 183 | HCDR2 (KABAT) | WINTDTGNPTYADDFKG |
| SEQ ID NO: 184 | HCDR3 (KABAT) | YGTLYSGYGFFFDS |
| SEQ ID NO: 206 | HCDR1 (CHOTHIA) | GYTFWHY |
| SEQ ID NO: 186 | HCDR2 (CHOTHIA) | NTDTGN |
| SEQ ID NO: 184 | HCDR3 (CHOTHIA) | YGTLYSGYGFFFDS |
| SEQ ID NO: 207 | HCDR1 (COMBINED) | GYTFWHYGMN |
| SEQ ID NO: 183 | HCDR2 (COMBINED) | WINTDTGNPTYADDFKG |

TABLE 26-continued

Sequences of Exemplary Monoclonal Antibodies (MAbs) and
Antibody Fragments (FABs) That Bind Mouse ENTPD2

| SEQ ID NO: 184 | HCDR3 (COMBINED) | YGTLYSGYGFFFDS |
|---|---|---|
| SEQ ID NO: 208 | HCDR1 (IMGT) | GYTFWHYG |
| SEQ ID NO: 189 | HCDR2 (IMGT) | INTDTGNP |
| SEQ ID NO: 190 | HCDR3 (IMGT) | VRYGTLYSGYGFFFDS |
| SEQ ID NO: 209 | VH | QVQLVQSGAELKQPGQSVKISCKASGYTFWHYGMN WVKQAPGQGLKWMGWINTDTGNPTYADDFKGRFV FSLDTSVSTAYLQISNLKNEDTATYYCVRYGTLYSGY GFFFDSWGQGTLVTVSS |
| SEQ ID NO: 210 | VH DNA | CAGGTCCAGCTGGTGCAGTCAGGAGCTGAGCTGA AGCAGCCTGGACAGTCGGTGAAGATCTCCTGCAAG GCTTCAGGGTACACCTTCTGGCACTATGGGATGAA CTGGGTGAAGCAGGCACCAGGACAGGGTCTAAAG TGGATGGGCTGGATCAACACTGACACTGGGAATCC AACATATGCTGATGACTTCAAAGGACGGTTTGTCT TCTCCTTGGACACCTCTGTCAGCACTGCATATCTGC AGATCAGCAACCTCAAGAATGAAGACACGGCCAC GTATTACTGTGTGAGATATGGAACCCTATATAGCG GATATGGGTTTTTTTTTGATTCCTGGGGCCAAGGG ACCCTGGTCACCGTCTCCTCA |
| SEQ ID NO: 211 | HC | QVQLVQSGAELKQPGQSVKISCKASGYTFWHYGMN WVKQAPGQGLKWMGWINTDTGNPTYADDFKGRFV FSLDTSVSTAYLQISNLKNEDTATYYCVRYGTLYSGY GFFFDSWGQGTLVTVSSAKTTAPSVYPLAPVCGDTT GSSVTLGCLVKGYFPEPVTLTWNSGSLSSGVHTFPAV LQSDLYTLSSSVTVTSSTWPSQSITCNVAHPASSTKV DKKIEPRGPTIKPCPPCKCPAPNLLGGPSVFIFPPKIKD VLMISLSPIVTCVVVDVSEDDPDVQISWFVNNVEVHT AQTQTHREDYNSTLRVVSALPIQHQDWMSGKEFKC KVNNKDLPAPIERTISKPKGSVRAPQVYVLPPPEEEM TKKQVTLTCMVTDFMPEDIYVEWTNNGKTELNYKN TEPVLDSDGSYFMYSKLRVEKKNWVERNSYSCSVV HEGLHNHHTTKSFSRTPGK |
| SEQ ID NO: 212 | HC DNA | CAGGTCCAGCTGGTGCAGTCAGGAGCTGAGCTGA AGCAGCCTGGACAGTCGGTGAAGATCTCCTGCAAG GCTTCAGGGTACACCTTCTGGCACTATGGGATGAA CTGGGTGAAGCAGGCACCAGGACAGGGTCTAAAG TGGATGGGCTGGATCAACACTGACACTGGGAATCC AACATATGCTGATGACTTCAAAGGACGGTTTGTCT TCTCCTTGGACACCTCTGTCAGCACTGCATATCTGC AGATCAGCAACCTCAAGAATGAAGACACGGCCAC GTATTACTGTGTGAGATATGGAACCCTATATAGCG GATATGGGTTTTTTTTTGATTCCTGGGGCCAAGGG ACCCTGGTCACCGTCTCCTCAGCCAAGACCACCGC CCCCAGCGTGTACCCCCTGGCCCCCGTGTGCGGCG ATACCACCGGCAGCAGCGTGACCCTGGGCTGCCTG GTGAAGGGCTACTTCCCCGAGCCCGTGACCCTGAC CTGGAACAGCGGCTCCCTGAGCAGCGGCGTGCAC ACCTTCCCCGCCGTGCTGCAGAGCGACCTGTACAC CCTGTCCAGCTCCGTGACCGTGACAAGCAGCACCT GGCCCAGCCAGAGCATCACCTGCAACGTGGCCCAC CCCGCCAGCAGCACCAAGGTGGACAAGAAGATCG AGCCCAGGGGCCCCACCATCAAGCCCTGCCCCCCC TGCAAGTGCCCAGCCCCCAACCTGCTGGGCGGACC CAGCGTGTTCATCTTCCCCCCCAAGATCAAGGACG TGCTGATGATCAGCCTGAGCCCCATCGTGACCTGC GTGGTGGTGGACGTGAGCGAGGACGACCCCGACG TGCAGATCAGCTGGTTCGTGAACAACGTGGAGGTG CACACCGCCCAGACCCAGACCCACCGGGAGGACT ACAACAGCACCCTGCGCGTCGTGTCCGCCCTGCCC ATCCAGCACCAGGACTGGATGAGCGGCAAAGAAT TCAAGTGCAAGGTGAACAACAAGGACCTGCCTGC CCCCATCGAGCGGACCATCAGCAAGCCCAAGGGC AGCGTGAGAGCCCCCAGGTGTACGTGCTGCCCCC TCCCGAGGAAGAGATGACCAAGAAGCAGGTGACA CTGACCTGCATGGTGACCGACTTCATGCCCGAGGA CATCTACGTGGAGTGGACCAACAACGGCAAGACC GAGCTGAACTACAAGAACACCGAGCCTGTGCTGG ACAGCGACGGCAGCTACTTCATGTACAGCAAGCTG CGGGTGGAGAAGAAAAACTGGGTGGAGCGGAACA |

TABLE 26-continued

Sequences of Exemplary Monoclonal Antibodies (MABs) and
Antibody Fragments (FABs) That Bind Mouse ENTPD2

| | | |
|---|---|---|
| | | GCTACAGCTGCAGCGTGGTGCACGAGGGCCTGCAC<br>AACCACCACACCACCAAGAGCTTCAGCCGGACCCC<br>CGGCAAG |
| SEQ ID NO: 195 | LCDR1 (KABAT) | KSSQSLFNSNTNKNYLN |
| SEQ ID NO: 196 | LCDR2 (KABAT) | YASTRHT |
| SEQ ID NO: 197 | LCDR3 (KABAT) | QQWYSYPWT |
| SEQ ID NO: 198 | LCDR1 (CHOTHIA) | SQSLFNSNTNKNY |
| SEQ ID NO: 199 | LCDR2 (CHOTHIA) | YAS |
| SEQ ID NO: 200 | LCDR3 (CHOTHIA) | WYSYPW |
| SEQ ID NO: 195 | LCDR1 (COMBINED) | KSSQSLFNSNTNKNYLN |
| SEQ ID NO: 196 | LCDR2 (COMBINED) | YASTRHT |
| SEQ ID NO: 197 | LCDR3 (COMBINED) | QQWYSYPWT |
| SEQ ID NO: 201 | LCDR1 (IMGT) | QSLFNSNTNKNY |
| SEQ ID NO: 199 | LCDR2 (IMGT) | YAS |
| SEQ ID NO: 197 | LCDR3 (IMGT) | QQWYSYPWT |
| SEQ ID NO: 202 | VL | DIMMTQSPSSLSVSAGEKATITCKSSQSLFNSNTNKN<br>YLNWYLQKPGQSPKLLFYYASTRHTGVPDRFIGSGS<br>GTDFTLTITSVQDEDLADYYCQQWYSYPWTFGPGTK<br>LEIK |
| SEQ ID NO: 203 | VL DNA | GACATCATGATGACCCAGTCTCCATCATCCCTGAG<br>TGTGTCAGCAGGAGAGAAAGCCACTATCACCTGCA<br>AGTCCAGTCAGAGTCTTTTCAACAGTAACACCAAC<br>AAGAACTACTTGAACTGGTACCTGCAGAAACCAG<br>GGCAGTCTCCTAAACTGCTGTTCTATTATGCATCCA<br>CTAGGCATACTGGGGTCCCTGATCGCTTCATAGGC<br>AGTGGATCTGGGACAGATTTCACTCTCACCATCAC<br>CAGTGTCCAGGATGAAGACCTGGCAGATTATTACT<br>GTCAGCAGTGGTATAGCTACCCGTGGACGTTCGGA<br>CCTGGCACCAAGCTGGAAATCAAA |
| SEQ ID NO: 204 | LC | DIMMTQSPSSLSVSAGEKATITCKSSQSLFNSNTNKN<br>YLNWYLQKPGQSPKLLFYYASTRHTGVPDRFIGSGS<br>GTDFTLTITSVQDEDLADYYCQQWYSYPWTFGPGTK<br>LEIKRADAAPTVSIFPPSSEQLTSGGASVVCFLNNFYP<br>KDINVKWKIDGSERQNGVLNSWTDQDSKDSTYSMS<br>STLTLTKDEYERHNSYTCEATHKTSTSPIVKSFNRNE<br>C |
| SEQ ID NO: 205 | LC DNA | GACATCATGATGACCCAGTCTCCATCATCCCTGAG<br>TGTGTCAGCAGGAGAGAAAGCCACTATCACCTGCA<br>AGTCCAGTCAGAGTCTTTTCAACAGTAACACCAAC<br>AAGAACTACTTGAACTGGTACCTGCAGAAACCAG<br>GGCAGTCTCCTAAACTGCTGTTCTATTATGCATCCA<br>CTAGGCATACTGGGGTCCCTGATCGCTTCATAGGC<br>AGTGGATCTGGGACAGATTTCACTCTCACCATCAC<br>CAGTGTCCAGGATGAAGACCTGGCAGATTATTACT<br>GTCAGCAGTGGTATAGCTACCCGTGGACGTTCGGA<br>CCTGGCACCAAGCTGGAAATCAAACGCGCTGATGC<br>CGCCCCTACCGTGAGCATCTTCCCCCCCAGCAGCG<br>AGCAGCTGACCAGCGGCGGAGCCAGCGTGGTGTG<br>CTTCCTGAACAACTTCTACCCCAAGGACATCAACG<br>TGAAGTGGAAGATCGACGGCAGCGAGCGGCAGAA<br>CGGCGTGCTGAACAGCTGGACCGACCAGGACAGC<br>AAGGACTCCACCTACAGCATGAGCAGCACCCTGAC<br>CCTGACCAAGGACGAGTACGAGCGGCACAACAGC<br>TACACCTGCGAGGCCACCCACAAGACCAGCACCA<br>GCCCCATCGTGAAGAGCTTCAACCGGAACGAGTGC |

TABLE 26-continued

Sequences of Exemplary Monoclonal Antibodies (MABs) and
Antibody Fragments (FABs) That Bind Mouse ENTPD2

ANTI-mouse
ENTPD2 MAB15

| | | |
|---|---|---|
| SEQ ID NO: 182 | HCDR1 (KABAT) | HYGMN |
| SEQ ID NO: 183 | HCDR2 (KABAT) | WINTDTGNPTYADDFKG |
| SEQ ID NO: 184 | HCDR3 (KABAT) | YGTLYSGYGFFFDS |
| SEQ ID NO: 213 | HCDR1 (CHOTHIA) | GYTFHHY |
| SEQ ID NO: 186 | HCDR2 (CHOTHIA) | NTDTGN |
| SEQ ID NO: 184 | HCDR3 (CHOTHIA) | YGTLYSGYGFFFDS |
| SEQ ID NO: 214 | HCDR1 (COMBINED) | GYTFHHYGMN |
| SEQ ID NO: 183 | HCDR2 (COMBINED) | WINTDTGNPTYADDFKG |
| SEQ ID NO: 184 | HCDR3 (COMBINED) | YGTLYSGYGFFFDS |
| SEQ ID NO: 215 | HCDR1 (IMGT) | GYTFHHYG |
| SEQ ID NO: 189 | HCDR2 (IMGT) | INTDTGNP |
| SEQ ID NO: 190 | HCDR3 (IMGT) | VRYGTLYSGYGFFFDS |
| SEQ ID NO: 216 | VH | QVQLVQSGAELKQPGQSVKISCKASGYTFHHYGMN WVKQAPGQGLKWMGWINTDTGNPTYADDFKGRFV FSLDTSVSTAYLQISNLKNEDTATYYCVRYGTLYSGY GFFFDSWGQGTLVTVSS |
| SEQ ID NO: 217 | VH DNA | CAGGTCCAGCTGGTGCAGTCAGGAGCTGAGCTGA AGCAGCCTGGACAGTCGGTGAAGATCTCCTGCAAG GCTTCAGGGTACACCTTCCACCACTATGGGATGAA CTGGGTGAAGCAGGCACCAGGACAGGGTCTAAAG TGGATGGGCTGGATCAACACTGACACTGGGAATCC AACATATGCTGATGACTTCAAAGGACGGTTTGTCT TCTCCTTGGACACCTCTGTCAGCACTGCATATCTGC AGATCAGCAACCTCAAGAATGAAGACACGGCCAC GTATTACTGTGTGAGATATGGAACCCTATATAGCG GATATGGGTTTTTTTTTGATTCCTGGGGCCAAGGG ACCCTGGTCACCGTCTCCTCA |
| SEQ ID NO: 218 | HC | QVQLVQSGAELKQPGQSVKISCKASGYTFHHYGMN WVKQAPGQGLKWMGWINTDTGNPTYADDFKGRFV FSLDTSVSTAYLQISNLKNEDTATYYCVRYGTLYSGY GFFFDSWGQGTLVTVSSAKTTAPSVYPLAPVCGDTT GSSVTLGCLVKGYFPEPVTLTWNSGSLSSGVHTFPAV LQSDLYTLSSSVTVTSSTWPSQSITCNVAHPASSTKV DKKIEPRGPTIKPCPPCKCPAPNLLGGPSVFIFPPKIKD VLMISLSPIVTCVVVDVSEDDPDVQISWFVNNVEVHT AQTQTHREDYNSTLRVVSALPIQHQDWMSGKEFKC KVNNKDLPAPIERTISKPKGSVRAPQVYVLPPPEEM TKKQVTLTCMVTDFMPEDIYVEWTNNGKTELNYKN TEPVLDSDGSYFMYSKLRVEKKNWVERNSYSCSVV HEGLHNHHTTKSFSRTPGK |
| SEQ ID NO: 219 | HC DNA | CAGGTCCAGCTGGTGCAGTCAGGAGCTGAGCTGA AGCAGCCTGGACAGTCGGTGAAGATCTCCTGCAAG GCTTCAGGGTACACCTTCCACCACTATGGGATGAA CTGGGTGAAGCAGGCACCAGGACAGGGTCTAAAG TGGATGGGCTGGATCAACACTGACACTGGGAATCC AACATATGCTGATGACTTCAAAGGACGGTTTGTCT TCTCCTTGGACACCTCTGTCAGCACTGCATATCTGC AGATCAGCAACCTCAAGAATGAAGACACGGCCAC GTATTACTGTGTGAGATATGGAACCCTATATAGCG GATATGGGTTTTTTTTTGATTCCTGGGGCCAAGGG ACCCTGGTCACCGTCTCCTCAGCCAAGACCACCGC CCCCAGCGTGTACCCCCTGGCCCCCGTGTGCGGCG ATACCACCGGCAGCAGCGTGACCCTGGGCTGCCTG GTGAAGGGCTACTTCCCCGAGCCCGTGACCCTGAC CTGGAACAGCGGCTCCCTGAGCAGCGGCGTGCAC ACCTTCCCCGCCGTGCTGCAGAGCGACCTGTACAC |

TABLE 26-continued

Sequences of Exemplary Monoclonal Antibodies (MABs) and
Antibody Fragments (FABs) That Bind Mouse ENTPD2

|  |  |  |
|---|---|---|
|  |  | CCTGTCCAGCTCCGTGACCGTGACAAGCAGCACCT<br>GGCCCAGCCAGAGCATCACCTGCAACGTGCCCCAC<br>CCCGCCAGCAGCACCAAGGTGGACAAGAAGATCG<br>AGCCCAGGGGCCCCACCATCAAGCCCTGCCCCCCC<br>TGCAAGTGCCCAGCCCCCAACCTGCTGGGCGGACC<br>CAGCGTGTTCATCTTCCCCCCCAAGATCAAGGACG<br>TGCTGATGATCAGCCTGAGCCCCATCGTGACCTGC<br>GTGGTGGTGGACGTGAGCGAGGACGACCCCGACG<br>TGCAGATCAGCTGGTTCGTGAACAACGTGGAGGTG<br>CACACCGCCCAGACCCAGACCCACCGGGAGGACT<br>ACAACAGCACCCTGCGCGTCGTGTCCGCCCTGCCC<br>ATCCAGCACCAGGACTGGATGAGCGGCAAAGAAT<br>TCAAGTGCAAGGTGAACAACAAGGACCTGCCTGC<br>CCCCATCGAGCGGACCATCAGCAAGCCCAAGGGC<br>AGCGTGAGAGCCCCCCAGGTGTACGTGCTGCCCCC<br>TCCCGAGGAAGAGATGACCAAGAAACAGGTGACA<br>CTGACCTGCATGGTGACCGACTTCATGCCCGAGGA<br>CATCTACGTGGAGTGGACCAACAACGGCAAGACC<br>GAGCTGAACTACAAGAACACCGAGCCTGTGCTGG<br>ACAGCGACGGCAGCTACTTCATGTACAGCAAGCTG<br>CGGGTGGAGAAGAAAAACTGGGTGGAGCGGAACA<br>GCTACAGCTGCAGCGTGGTGCACGAGGGCCTGCAC<br>AACCACCACACCACCAAGAGCTTCAGCCGGACCCC<br>CGGCAAG |
| SEQ ID NO: 195 | LCDR1 (KABAT) | KSSQSLFNSNTNKNYLN |
| SEQ ID NO: 196 | LCDR2 (KABAT) | YASTRHT |
| SEQ ID NO: 197 | LCDR3 (KABAT) | QQWYSYPWT |
| SEQ ID NO: 198 | LCDR1 (CHOTHIA) | SQSLFNSNTNKNY |
| SEQ ID NO: 199 | LCDR2 (CHOTHIA) | YAS |
| SEQ ID NO: 200 | LCDR3 (CHOTHIA) | WYSYPW |
| SEQ ID NO: 195 | LCDR1 (COMBINED) | KSSQSLFNSNTNKNYLN |
| SEQ ID NO: 196 | LCDR2 (COMBINED) | YASTRHT |
| SEQ ID NO: 197 | LCDR3 (COMBINED) | QQWYSYPWT |
| SEQ ID NO: 201 | LCDR1 (IMGT) | QSLFNSNTNKNY |
| SEQ ID NO: 199 | LCDR2 (IMGT) | YAS |
| SEQ ID NO: 197 | LCDR3 (IMGT) | QQWYSYPWT |
| SEQ ID NO: 202 | VL | DIMMTQSPSSLSVSAGEKATITCKSSQSLFNSNTNKN<br>YLNWYLQKPGQSPKLLFYYASTRHTGVPDRFIGSGS<br>GTDFTLTITSVQDEDLADYYCQQWYSYPWTFGPGTK<br>LEIK |
| SEQ ID NO: 203 | VL DNA | GACATCATGATGACCCAGTCTCCATCATCCCTGAG<br>TGTGTCAGCAGGAGAGAAAGCCACTATCACCTGCA<br>AGTCCAGTCAGAGTCTTTTCAACAGTAACACCAAC<br>AAGAACTACTTGAACTGGTACCTGCAGAAACCAG<br>GGCAGTCTCCTAAACTGCTGTTCTATTATGCATCCA<br>CTAGGCATACTGGGGTCCCTGATCGCTTCATAGGC<br>AGTGGATCTGGGACAGATTTCACTCTCACCATCAC<br>CAGTGTCCAGGATGAAGACCTGGCAGATTATTACT<br>GTCAGCAGTGGTATAGCTACCCGTGGACGTTCGGA<br>CCTGGCACCAAGCTGGAAATCAAA |
| SEQ ID NO: 204 | LC | DIMMTQSPSSLSVSAGEKATITCKSSQSLFNSNTNKN<br>YLNWYLQKPGQSPKLLFYYASTRHTGVPDRFIGSGS<br>GTDFTLTITSVQDEDLADYYCQQWYSYPWTFGPGTK<br>LEIKRADAAPTVSIFPPSSEQLTSGGASVVCFLNNFYP<br>KDINVKWKIDGSERQNGVLNSWTDQDSKDSTYSMS<br>STLTLTKDEYERHNSYTCEATHKTSTSPIVKSFNRNE<br>C |

TABLE 26-continued

Sequences of Exemplary Monoclonal Antibodies (MAbs) and
Antibody Fragments (FABs) That Bind Mouse ENTPD2

| | | |
|---|---|---|
| SEQ ID NO: 205 | LC DNA | GACATCATGATGACCCAGTCTCCATCATCCCTGAG<br>TGTGTCAGCAGGAGAGAAAGCCACTATCACCTGCA<br>AGTCCAGTCAGAGTCTTTTCAACAGTAACACCAAC<br>AAGAACTACTTGAACTGGTACCTGCAGAAACCAG<br>GGCAGTCTCCTAAACTGCTGTTCTATTATGCATCCA<br>CTAGGCATACTGGGGTCCCTGATCGCTTCATAGGC<br>AGTGGATCTGGGACAGATTTCACTCTCACCATCAC<br>CAGTGTCCAGGATGAAGACCTGGCAGATTATTACT<br>GTCAGCAGTGGTATAGCTACCCGTGGACGTTCGGA<br>CCTGGCACCAAGCTGGAAATCAAACGCGCTGATGC<br>CGCCCCTACCGTGAGCATCTTCCCCCCCAGCAGCG<br>AGCAGCTGACCAGCGGCGGAGCCAGCGTGGTGTG<br>CTTCCTGAACAACTTCTACCCCAAGGACATCAACG<br>TGAAGTGGAAGATCGACGGCAGCGAGCGGCAGAA<br>CGGCGTGCTGAACAGCTGGACCGACCAGGACAGC<br>AAGGACTCCACCTACAGCATGAGCAGCACCCTGAC<br>CCTGACCAAGGACGAGTACGAGCGGCACAACAGC<br>TACACCTGCGAGGCCACCCACAAGACCAGCACCA<br>GCCCCATCGTGAAGAGCTTCAACCGGAACGAGTGC |

ANTI-mouse
ENTPD2 FAB24

| | | |
|---|---|---|
| SEQ ID NO: 182 | HCDR1 (KABAT) | HYGMN |
| SEQ ID NO: 183 | HCDR2 (KABAT) | WINTDTGNPTYADDFKG |
| SEQ ID NO: 184 | HCDR3 (KABAT) | YGTLYSGYGFFFDS |
| SEQ ID NO: 185 | HCDR1 (CHOTHIA) | GYTFTHY |
| SEQ ID NO: 186 | HCDR2 (CHOTHIA) | NTDTGN |
| SEQ ID NO: 184 | HCDR3 (CHOTHIA) | YGTLYSGYGFFFDS |
| SEQ ID NO: 187 | HCDR1 (COMBINED) | GYTFTHYGMN |
| SEQ ID NO: 183 | HCDR2 (COMBINED) | WINTDTGNPTYADDFKG |
| SEQ ID NO: 184 | HCDR3 (COMBINED) | YGTLYSGYGFFFDS |
| SEQ ID NO: 188 | HCDR1 (IMGT) | GYTFTHYG |
| SEQ ID NO: 189 | HCDR2 (IMGT) | INTDTGNP |
| SEQ ID NO: 190 | HCDR3 (IMGT) | VRYGTLYSGYGFFFDS |
| SEQ ID NO: 191 | VH | QVQLVQSGAELKQPGQSVKISCKASGYTFTHYGMN<br>WVKQAPGQGLKWMGWINTDTGNPTYADDFKGRFV<br>FSLDTSVSTAYLQISNLKNEDTATYYCVRYGTLYSGY<br>GFFFDSWGQGTLVTVSS |
| SEQ ID NO: 192 | VH DNA | CAGGTCCAGCTGGTGCAGTCAGGAGCTGAGCTGA<br>AGCAGCCTGGACAGTCGGTGAAGATCTCCTGCAAG<br>GCTTCAGGGTACACCTTCACACACTATGGGATGAA<br>CTGGGTGAAGCAGGCACCAGGACAGGGTCTAAAG<br>TGGATGGGCTGGATCAACACTGACACTGGGAATCC<br>AACATATGCTGATGACTTCAAAGGACGGTTTGTCT<br>TCTCCTTGGACACCTCTGTCAGCACTGCATATCTGC<br>AGATCAGCAACCTCAAGAATGAAGACACGGCCAC<br>GTATTACTGTGTGAGATATGGAACCCTATATAGCG<br>GATATGGGTTTTTTTTTGATTCCTGGGGCCAAGGG<br>ACCCTGGTCACCGTCTCCTCA |
| SEQ ID NO: 338 | HC | QVQLVQSGAELKQPGQSVKISCKASGYTFTHYGMN<br>WVKQAPGQGLKWMGWINTDTGNPTYADDFKGRFV<br>FSLDTSVSTAYLQISNLKNEDTATYYCVRYGTLYSGY<br>GFFFDSWGQGTLVTVSSASTKGPSVFPLAPSSKSTSG<br>GTAALGCLVKDYFPEPVTVSWNSGALTSGVHTFPAV<br>LQSSGLYSLSSVVTVPSSSLGTQTYICNVNHKPSNTK<br>VDKRVEPKSC |

TABLE 26-continued

Sequences of Exemplary Monoclonal Antibodies (MAbs) and
Antibody Fragments (FAbs) That Bind Mouse ENTPD2

| SEQ ID NO: 339 | HC DNA | CAGGTCCAGCTGGTGCAGTCAGGAGCTGAGCTGA
AGCAGCCTGGACAGTCGGTGAAGATCTCCTGCAAG
GCTTCAGGGTACACCTTCACACACTATGGGATGAA
CTGGGTGAAGCAGGCACCAGGACAGGGTCTAAAG
TGGATGGGCTGGATCAACACTGACACTGGGAATCC
AACATATGCTGATGACTTCAAAGGACGGTTTGTCT
TCTCCTTGGACACCTCTGTCAGCACTGCATATCTGC
AGATCAGCAACCTCAAGAATGAAGACACGGCCAC
GTATTACTGTGTGAGATATGGAACCCTATATAGCG
GATATGGGTTTTTTTTTGATTCCTGGGGCCAAGGG
ACCCTGGTCACCGTCTCCTCAgctagcaccaagggcccaagtg
tgtttcccctggcccccagcagcaagtctacttccggcggaactgctgccctgggtt
gcctggtgaaggactacttccccgagcccgtgacagtgtcctggaactctggggct
ctgaccttccggcgtgcacaccttccccgccgtgctgcagagcagcggcctgtacag
cctgagcagcgtggtgacagtgccctccagctctctgggaacccagacctatatct
gcaacgtgaaccacaagcccagcaacaccaaggtggacaagagagtggagccc
aagagctgc |
|---|---|---|
| SEQ ID NO: 195 | LCDR1 (KABAT) | KSSQSLFNSNTNKNYLN |
| SEQ ID NO: 196 | LCDR2 (KABAT) | YASTRHT |
| SEQ ID NO: 197 | LCDR3 (KABAT) | QQWYSYPWT |
| SEQ ID NO: 198 | LCDR1 (CHOTHIA) | SQSLFNSNTNKNY |
| SEQ ID NO: 199 | LCDR2 (CHOTHIA) | YAS |
| SEQ ID NO: 200 | LCDR3 (CHOTHIA) | WYSYPW |
| SEQ ID NO: 195 | LCDR1 (COMBINED) | KSSQSLFNSNTNKNYLN |
| SEQ ID NO: 196 | LCDR2 (COMBINED) | YASTRHT |
| SEQ ID NO: 197 | LCDR3 (COMBINED) | QQWYSYPWT |
| SEQ ID NO: 201 | LCDR1 (IMGT) | QSLFNSNTNKNY |
| SEQ ID NO: 199 | LCDR2 (IMGT) | YAS |
| SEQ ID NO: 197 | LCDR3 (IMGT) | QQWYSYPWT |
| SEQ ID NO: 202 | VL | DIMMTQSPSSLSVSAGEKATITCKSSQSLFNSNTNKN
YLNWYLQKPGQSPKLLFYYASTRHTGVPDRFIGSGS
GTDFTLTITSVQDEDLADYYCQQWYSYPWTFGPGTK
LEIK |
| SEQ ID NO: 203 | VL DNA | GACATCATGATGACCCAGTCTCCATCATCCCTGAG
TGTGTCAGCAGGAGAGAAAGCCACTATCACCTGCA
AGTCCAGTCAGAGTCTTTTCAACAGTAACACCAAC
AAGAACTACTTGAACTGGTACCTGCAGAAACCAG
GGCAGTCTCCTAAACTGCTGTTCTATTATGCATCCA
CTAGGCATACTGGGGTCCCTGATCGCTTCATAGGC
AGTGGATCTGGGACAGATTTCACTCTCACCATCAC
CAGTGTCCAGGATGAAGACCTGGCAGATTATTACT
GTCAGCAGTGGTATAGCTACCCGTGGACGTTCGGA
CCTGGCACCAAGCTGGAAATCAAA |
| SEQ ID NO: 340 | LC | DIMMTQSPSSLSVSAGEKATITCKSSQSLFNSNTNKN
YLNWYLQKPGQSPKLLFYYASTRHTGVPDRFIGSGS
GTDFTLTITSVQDEDLADYYCQQWYSYPWTFGPGTK
LEIKRTVAAPSVFIFPPSDEQLKSGTASVVCLLNNFYP
REAKVQWKVDNALQSGNSQESVTEQDSKDSTYSLSS
TLTLSKADYEKHKVYACEVTHQGLSSPVTKSFNRGE
C |
| SEQ ID NO: 341 | LC DNA | GACATCATGATGACCCAGTCTCCATCATCCCTGAG
TGTGTCAGCAGGAGAGAAAGCCACTATCACCTGCA
AGTCCAGTCAGAGTCTTTTCAACAGTAACACCAAC
AAGAACTACTTGAACTGGTACCTGCAGAAACCAG
GGCAGTCTCCTAAACTGCTGTTCTATTATGCATCCA
CTAGGCATACTGGGGTCCCTGATCGCTTCATAGGC
AGTGGATCTGGGACAGATTTCACTCTCACCATCAC |

TABLE 26-continued

Sequences of Exemplary Monoclonal Antibodies (MABs) and
Antibody Fragments (FABs) That Bind Mouse ENTPD2

```
CAGTGTCCAGGATGAAGACCTGGCAGATTATTACT
GTCAGCAGTGGTATAGCTACCCGTGGACGTTCGGA
CCTGGCACCAAGCTGGAAATCAAAcgtacggtggccgctcc
cagcgtgttcatcttccccccagcgacgagcagctgaagagtggcaccgccagc
gtggtgtgcctgctgaacaacttctaccccgggaggccaaggtgcagtggaagg
tggacaacgccctgcagagcggcaacagccaggagagcgtcaccgagcaggac
agcaaggactccacctacagcctgagcagcaccctgaccctgagcaaggccgac
tacgagaagcataaggtgtacgcctgcgaggtgacccaccagggcctgtccagcc
ccgtgaccaagagcttcaacaggggcgagtgc
```

In some embodiments, the anti-mouse ENTPD2 antibody or antibody fragment (e.g., an antigen binding fragment) comprises a VH domain having an amino acid sequence of any VH domain described in Table 26. Other suitable anti-mouse ENTPD2 antibodies or antibody fragments (e.g., antigen binding fragments) can include amino acids that have been mutated, yet have at least 80, 85, 90, 95, 96, 97, 98, or 99 percent identity in the VH domain with the VH regions depicted in the sequences described in Table 26. The present disclosure in certain embodiments also provides antibodies or antibody fragments (e.g., antigen binding fragments) that specifically bind to mouse ENTPD2, wherein the antibodies or antibody fragments (e.g., antigen binding fragments) comprise a VH CDR having an amino acid sequence of any one of the VH CDRs listed in Table 26. In particular embodiments, the invention provides antibodies or antibody fragments (e.g., antigen binding fragments) that specifically bind to mouse ENTPD2, comprising (or alternatively, consist of) one, two, three, four, five or more VH CDRs having an amino acid sequence of any one of the VH CDRs listed in Table 26.

In some embodiments, the anti-mouse ENTPD2 antibody or antibody fragment (e.g., antigen binding fragment) comprises a VL domain having an amino acid sequence of any VL domain described in Table 26. Other suitable anti-mouse ENTPD2 antibodies or antibody fragments (e.g., antigen binding fragments) can include amino acids that have been mutated, yet have at least 80, 85, 90, 95, 96, 97, 98, or 99 percent identity in the VL domain with the VL regions depicted in the sequences described in Table 26. The present disclosure also provides antibodies or antibody fragments (e.g., antigen binding fragments) that specifically bind to mouse ENTPD2, the antibodies or antibody fragments (e.g., antigen binding fragments) comprise a VL CDR having an amino acid sequence of any one of the VL CDRs listed in Table 26. In particular, the invention provides antibodies or antibody fragments (e.g., antigen binding fragments) that specifically bind to mouse ENTPD2, which comprise (or alternatively, consist of) one, two, three or more VL CDRs having an amino acid sequence of any one of the VL CDRs listed in Table 26.

Other anti-mouse ENTPD2 antibodies or antibody fragments (e.g., antigen binding fragment) disclosed herein include amino acids that have been mutated, yet have at least 80, 85, 90, 95, 96, 97, 98, or 99 percent identity in the CDR regions with the CDR regions depicted in the sequences described in Table 26. In some embodiments, it includes mutant amino acid sequences wherein no more than 1, 2, 3, 4 or 5 amino acids have been mutated in the CDR regions when compared with the CDR regions depicted in the sequence described in Table 26.

Also provided herein are nucleic acid sequences that encode VH, VL, full length heavy chain, and full length light chain of antibodies and antigen binding fragments thereof that specifically bind to mouse ENTPD2, e.g., the nucleic acid sequences in Table 26. Such nucleic acid sequences can be optimized for expression in mammalian cells.

Provided herein are also antibodies or antigen binding fragments thereof that specifically bind to an epitope in mouse ENTPD2, wherein the epitope comprises at least one (e.g., at least two, at least three, at least four, at least five, at least six, at least seven, at least eight, at least nine, at least ten, at least eleven, at least twelve, at least thirteen, at least fourteen, at least fifteen, at least twenty) of the following residues: Ser74, Cys75, Asp76, Tyr349, Tyr350, Asp353, Phe354, Thr357, Val358, Gly360, Gln385, Ala386, Arg387, Val388, Pro389, Gly390, Gln391, Thr393, Arg394, or Tyr398.

Framework and Engineered or Modified Antibodies

An antibody of the invention further can be prepared using an antibody having one or more of the VH and/or VL sequences as starting material to engineer a modified antibody, which modified antibody may have altered properties from the starting antibody. An antibody can be engineered by modifying one or more residues within one or both variable regions (i.e., VH and/or VL), for example within one or more CDR regions and/or within one or more framework regions. Additionally or alternatively, an antibody can be engineered by modifying residues within the constant region(s), for example to alter the effector function(s) of the antibody.

One type of variable region engineering that can be performed is CDR grafting. Antibodies interact with target antigens predominantly through amino acid residues that are located in the six heavy and light chain complementarity determining regions (CDRs). For this reason, the amino acid sequences within CDRs are more diverse between individual antibodies than sequences outside of CDRs. Because CDR sequences are responsible for most antibody-antigen interactions, it is possible to express recombinant antibodies that mimic the properties of specific naturally occurring antibodies by constructing expression vectors that include CDR sequences from the specific naturally occurring antibody grafted onto framework sequences from a different antibody with different properties (see, e.g., Riechmann, L. et al., 1998 Nature 332:323-327; Jones, P. et al., 1986 Nature 321:522-525; Queen, C. et al., 1989 Proc. Natl. Acad., U.S.A. 86:10029-10033; U.S. Pat. No. 5,225,539 to Winter, and U.S. Pat. Nos. 5,530,101; 5,585,089; 5,693,762 and 6,180,370 to Queen et al.)

Such framework sequences can be obtained from public DNA databases or published references that include germline antibody gene sequences or rearranged antibody sequences. For example, germline DNA sequences for human heavy and light chain variable region genes can be found in the "VBase" human germline sequence database (available on the Internet at mrc-cpe.cam.ac.uk/vbase), as well as in Kabat, E. A., et al., 1991 Sequences of Proteins of Immunological Interest, Fifth Edition, U.S. Department of Health and Human Services, NIH Publication No. 91-3242; Tomlinson, I. M., et al., 1992 J. fol. Biol. 227:776-798; and Cox, J. P. L. et al., 1994 Eur. J Immunol. 24:827-836). For example, germline DNA sequences for human heavy and light chain variable region genes and rearranged antibody sequences can be found in "IMGT" database (available on the Internet at imgt.org; see Lefranc, M. P. et al., 1999 Nucleic Acids Res. 27:209-212).

An example of framework sequences for use in the antibodies and antigen binding fragments thereof of the invention are those that are structurally similar to the framework sequences used by selected antibodies and antigen binding fragments thereof of the invention, e.g., consensus sequences and/or framework sequences used by monoclonal antibodies of the invention. The VH CDR1, 2 and 3 sequences, and the VL CDR1, 2 and 3 sequences, can be grafted onto framework regions that have the identical sequence as that found in the germline immunoglobulin gene from which the framework sequence derive, or the CDR sequences can be grafted onto framework regions that contain one or more mutations as compared to the germline sequences. For example, it has been found that in certain instances it is beneficial to mutate residues within the framework regions to maintain or enhance the antigen binding ability of the antibody (see e.g., U.S. Pat. Nos. 5,530,101; 5,585,089; 5,693,762 and 6,180,370 to Queen et al).

Another type of variable region modification is to mutate amino acid residues within the VH and/or VL CDR1, CDR2 and/or CDR3 regions to thereby improve one or more binding properties (e.g., affinity) of the antibody of interest, known as "affinity maturation". Site-directed mutagenesis or PCR-mediated mutagenesis can be performed to introduce the mutation(s) and the effect on antibody binding, or other functional property of interest, can be evaluated in in vitro or in vivo assays as described herein and provided in the Examples. Conservative modifications (as discussed above) can be introduced. The mutations may be amino acid substitutions, additions or deletions. Moreover, typically no more than one, two, three, four or five residues within a CDR region are altered.

A wide variety of antibody/immunoglobulin frameworks or scaffolds can be employed so long as the resulting polypeptide includes at least one binding region which specifically binds to ENTPD2 (e.g., human ENTPD2 protein). Such frameworks or scaffolds include the 5 main idiotypes of human immunoglobulins, antigen-binding fragments thereof, and include immunoglobulins of other animal species, preferably having humanized aspects. Single heavy-chain antibodies such as those identified in camelids are of particular interest in this regard. Novel frameworks, scaffolds and fragments continue to be discovered and developed by those skilled in the art.

In one aspect, the invention pertains to a method of generating non-immunoglobulin based antibodies using non-immunoglobulin scaffolds onto which CDRs of the invention can be grafted. Known or future non-immunoglobulin frameworks and scaffolds may be employed, as long as they comprise a binding region specific for the target ENTPD2 protein. Known non-immunoglobulin frameworks or scaffolds include, but are not limited to, fibronectin (Compound Therapeutics, Inc., Waltham, Mass.), ankyrin (Molecular Partners AG, Zurich, Switzerland), domain antibodies (Domantis, Ltd., Cambridge, Mass., and Ablynx nv, Zwijnaarde, Belgium), lipocalin (Pieris Proteolab AG, Freising, Germany), small modular immuno-pharmaceuticals (Trubion Pharmaceuticals Inc., Seattle, Wash.), maxybodies (Avidia, Inc., Mountain View, Calif.), Protein A (Affibody AG, Sweden), and affilin (gamma-crystallin or ubiquitin) (SciI Proteins GmbH, Halle, Germany).

The fibronectin scaffolds are based on fibronectin type III domain (e.g., the tenth module of the fibronectin type III (10 Fn3 domain)). The fibronectin type III domain has 7 or 8 beta strands which are distributed between two beta sheets, which themselves pack against each other to form the core of the protein, and further containing loops (analogous to CDRs) which connect the beta strands to each other and are solvent exposed. There are at least three such loops at each edge of the beta sheet sandwich, where the edge is the boundary of the protein perpendicular to the direction of the beta strands (see U.S. Pat. No. 6,818,418). These fibronectin-based scaffolds are not an immunoglobulin, although the overall fold is closely related to that of the smallest functional antibody fragment, the variable region of the heavy chain, which comprises the entire antigen recognition unit in camel and llama IgG. Because of this structure, the non-immunoglobulin antibody mimics antigen binding properties that are similar in nature and affinity for those of antibodies. These scaffolds can be used in a loop randomization and shuffling strategy in vitro that is similar to the process of affinity maturation of antibodies in vivo. These fibronectin-based molecules can be used as scaffolds where the loop regions of the molecule can be replaced with CDRs of the invention using standard cloning techniques.

The ankyrin technology is based on using proteins with ankyrin derived repeat modules as scaffolds for bearing variable regions which can be used for binding to different targets. The ankyrin repeat module is a 33 amino acid polypeptide consisting of two antiparallel alpha-helices and a beta-turn. Binding of the variable regions is mostly optimized by using ribosome display.

Avimers are derived from natural A-domain containing protein such as LRP-1. These domains are used by nature for protein-protein interactions and in human over 250 proteins are structurally based on A-domains. Avimers consist of a number of different "A-domain" monomers (2-10) linked via amino acid linkers. Avimers can be created that can bind to the target antigen using the methodology described in, for example, U.S. Patent Application Publication Nos. 20040175756; 20050053973; 20050048512; and 20060008844.

Affibody affinity ligands are small, simple proteins composed of a three-helix bundle based on the scaffold of one of the IgG-binding domains of Protein A. Protein A is a surface protein from the bacterium *Staphylococcus aureus*. This scaffold domain consists of 58 amino acids, 13 of which are randomized to generate affibody libraries with a large number of ligand variants (See e.g., U.S. Pat. No. 5,831,012). Affibody molecules mimic antibodies, they have a molecular weight of 6 kDa, compared to the molecular weight of antibodies, which is 150 kDa. In spite of its small size, the binding site of affibody molecules is similar to that of an antibody.

Anticalins are products developed by the company Pieris ProteoLab AG. They are derived from lipocalins, a widespread group of small and robust proteins that are usually involved in the physiological transport or storage of chemically sensitive or insoluble compounds. Several natural lipocalins occur in human tissues or body liquids. The protein architecture is reminiscent of immunoglobulins, with hypervariable loops on top of a rigid framework. However, in contrast with antibodies or their recombinant fragments, lipocalins are composed of a single polypeptide chain with 160 to 180 amino acid residues, being just marginally bigger than a single immunoglobulin domain. The set of four loops, which makes up the binding pocket, shows pronounced structural plasticity and tolerates a variety of side chains. The binding site can thus be reshaped in a proprietary process in order to recognize prescribed target molecules of different shape with high affinity and specificity. One protein of lipocalin family, the bilin-binding protein (BBP) of Pieris Brassicae has been used to develop anticalins by mutagenizing the set of four loops. One example of a patent application describing anticalins is in PCT Publication No. WO 199916873.

Affilin molecules are small non-immunoglobulin proteins which are designed for specific affinities towards proteins and small molecules. New affilin molecules can be very quickly selected from two libraries, each of which is based on a different human derived scaffold protein. Affilin molecules do not show any structural homology to immunoglobulin proteins. Currently, two affilin scaffolds are employed, one of which is gamma crystalline, a human structural eye lens protein and the other is "ubiquitin" superfamily proteins. Both human scaffolds are very small, show high temperature stability and are almost resistant to pH changes and denaturing agents. This high stability is mainly due to the expanded beta sheet structure of the proteins. Examples of gamma crystalline derived proteins are described in WO200104144 and examples of "ubiquitin-like" proteins are described in WO2004106368.

Protein epitope mimetics (PEM) are medium-sized, cyclic, peptide-like molecules (MW 1-2 kDa) mimicking beta-hairpin secondary structures of proteins, the major secondary structure involved in protein-protein interactions.

Engineered antibodies and antigen-binding fragments thereof of the invention include those in which modifications have been made to framework residues within VH and/or VL, e.g. to improve the properties of the antibody. Typically such framework modifications are made to decrease the immunogenicity of the antibody. For example, one approach is to "backmutate" one or more framework residues to the corresponding germline sequence. More specifically, an antibody that has undergone somatic mutation may contain framework residues that differ from the germline sequence from which the antibody is derived. Such residues can be identified by comparing the antibody framework sequences to the germline sequences from which the antibody is derived. To return the framework region sequences to their germline configuration, the somatic mutations can be "backmutated" to the germline sequence by, for example, site-directed mutagenesis. Such "backmutated" antibodies are also intended to be encompassed by the invention.

Another type of framework modification involves mutating one or more residues within the framework region, or even within one or more CDR regions, to remove T cell-epitopes to thereby reduce the potential immunogenicity of the antibody. This approach is also referred to as "deimmunization" and is described in further detail in U.S. Patent Publication No. 20030153043 by Carr et al.

In addition or alternative to modifications made within the framework or CDR regions, antibodies of the invention may be engineered to include modifications within the Fc region, typically to alter one or more functional properties of the antibody, such as serum half-life, complement fixation, Fc receptor binding, and/or antigen-dependent cellular cytotoxicity. Furthermore, an antibody of the invention may be chemically modified (e.g., one or more chemical moieties can be attached to the antibody) or be modified to alter its glycosylation, again to alter one or more functional properties of the antibody. Each of these embodiments is described in further detail below. The numbering of residues in the Fc region is that of the EU index of Kabat.

In one embodiment, the hinge region of CH1 is modified such that the number of cysteine residues in the hinge region is altered, e.g., increased or decreased. This approach is described further in U.S. Pat. No. 5,677,425 by Bodmer et al. The number of cysteine residues in the hinge region of CH1 is altered to, for example, facilitate assembly of the light and heavy chains or to increase or decrease the stability of the antibody.

In another embodiment, the Fc hinge region of an antibody is mutated to decrease the biological half-life of the antibody. More specifically, one or more amino acid mutations are introduced into the CH2-CH3 domain interface region of the Fc-hinge fragment such that the antibody has impaired Staphylococcyl protein A (SpA) binding relative to native Fc-hinge domain SpA binding. This approach is described in further detail in U.S. Pat. No. 6,165,745 by Ward et al.

In another embodiment, the antibody is modified to increase its biological half-life. Various approaches are possible. For example, one or more of the following mutations can be introduced: T252L, T254S, T256F, as described in U.S. Pat. No. 6,277,375 to Ward. Alternatively, to increase the biological half life, the antibody can be altered within the CH1 or CL region to contain a salvage receptor binding epitope taken from two loops of a CH2 domain of an Fc region of an IgG, as described in U.S. Pat. Nos. 5,869,046 and 6,121,022 by Presta et al.

In one embodiment, the Fc region is altered by replacing at least one amino acid residue with a different amino acid residue to alter the effector functions of the antibody. For example, one or more amino acids can be replaced with a different amino acid residue such that the antibody has an altered affinity for an effector ligand but retains the antigen-binding ability of the parent antibody. The effector ligand to which affinity is altered can be, for example, an Fc receptor or the C1 component of complement. This approach is described in further detail in U.S. Pat. Nos. 5,624,821 and 5,648,260, both by Winter et al.

In another embodiment, one or more amino acids selected from amino acid residues can be replaced with a different amino acid residue such that the antibody has altered C1q binding and/or reduced or abolished complement dependent cytotoxicity (CDC). This approach is described in further detail in U.S. Pat. No. 6,194,551 by Idusogie et al.

In another embodiment, one or more amino acid residues are altered to thereby alter the ability of the antibody to fix complement. This approach is described further in PCT Publication WO 94/29351 by Bodmer et al.

In some embodiments, the ENTPD2-binding antibodies or antigen binding fragments thereof contain a human IgG1 constant region. In some embodiments, the human IgG1 constant region includes an Fc region.

In some embodiments, the Fc region of the ENTPD2-binding antibodies or antigen binding fragments thereof includes one or more mutations mediating reduced or no antibody-dependent cellular cytotoxicity (ADCC) or complement-dependent cytotoxicity (CDC). In some embodiments, amino acid residues L234 and L235 of the IgG1 constant region are substituted to A234 and A235. In some embodiments, amino acid residue N267 of the IgG1 constant region is substituted to A267. In some embodiments, amino acid residues D265 and P329 of the IgG1 constant region are substituted to A265 and A329. In certain embodiments, the Fc region optionally comprises a mutation or combination of mutations conferring reduced effector function selected from any one of D265A, P329A, P329G, N297A, D265A/P329A, D265A/N297A, L234/L235A, P329A/L234A/L235A, and P329G/L234A/L235A. In some embodiments, the Fc region comprises a mutation or combination of mutations conferring reduced effector function selected from any one of D265A, P329A, P329G, N297A, D265A/P329A, D265A/N297A, L234/L235A, P329A/L234A/L235A, and P329G/L234A/L235A (all positions by EU numbering).

In yet another embodiment, the Fc region is modified to increase the ability of the antibody to mediate antibody dependent cellular cytotoxicity (ADCC) and/or to increase the affinity of the antibody for an Fc-gamma receptor by modifying one or more amino acids. This approach is described further in PCT Publication WO 00/42072 by Presta. Moreover, the binding sites on human IgG1 for Fc-gamma RI, Fc-gamma RII, Fc-gamma RIII and FcRn have been mapped and variants with improved binding have been described (see Shields, R. L. et al., 2001 J. Biol. Chen. 276:6591-6604). For example, the Fc region can comprise a mutation or combination of mutations conferring increased effector function selected from any one of S239D, I332E, A330L, S298A, E333A, E333S, K334A, K236A, K236W, F243L, P247I, D280H, K290S, R292P, S298D, S298V, Y300L, V305I, A339D, A339Q, A339T, P396L (all positions by EU numbering).

In still another embodiment, the glycosylation of an antibody is modified. For example, an aglycoslated antibody can be made (i.e., the antibody lacks glycosylation). Glycosylation can be altered to, for example, increase the affinity of the antibody for antigen. Such carbohydrate modifications can be accomplished by, for example, altering one or more sites of glycosylation within the antibody sequence. For example, one or more amino acid substitutions can be made that result in elimination of one or more variable region framework glycosylation sites to thereby eliminate glycosylation at that site. Such aglycosylation may increase the affinity of the antibody for antigen. Such an approach is described in further detail in U.S. Pat. Nos. 5,714,350 and 6,350,861 by Co et al.

Additionally or alternatively, an antibody can be made that has an altered type of glycosylation, such as a hypofucosylated antibody having reduced amounts of fucosyl residues or an antibody having increased bisecting GlcNac structures. Such altered glycosylation patterns have been demonstrated to increase the ADCC ability of antibodies. Such carbohydrate modifications can be accomplished by, for example, expressing the antibody in a host cell with altered glycosylation machinery. Cells with altered glycosylation machinery have been described in the art and can be used as host cells in which to express recombinant antibodies of the invention to thereby produce an antibody with altered glycosylation. For example, EP 1,176,195 by Hang et al. describes a cell line with a functionally disrupted FUT8 gene, which encodes a fucosyl transferase, such that antibodies expressed in such a cell line exhibit hypofucosylation. PCT Publication WO 03/035835 by Presta describes a variant CHO cell line, LecI3 cells, with reduced ability to attach fucose to Asn (297)-linked carbohydrates, also resulting in hypofucosylation of antibodies expressed in that host cell (see also Shields, R. L. et al., 2002 J. Biol. Chem. 277:26733-26740). PCT Publication WO 99/54342 by Umana et al. describes cell lines engineered to express glycoprotein-modifying glycosyl transferases (e.g., beta (1,4)-N acetylglucosaminyltransferase III (GnTIII)) such that antibodies expressed in the engineered cell lines exhibit increased bisecting GlcNac structures which results in increased ADCC activity of the antibodies (see also Umana et al., 1999 Nat. Biotech. 17:176-180).

In some embodiments, the ENTPD2 antibody has an IgG1 isotype with one or more mutations (e.g., relative to a wild-type Fc region of the same isotype). In some embodiments, the one or more mutations are selected from N297A, N297Q (Bolt S et al. (1993) Eur J Immunol 23:403-411), D265A, L234A, L235A (McEarchern et al., (2007) Blood, 109:1185-1192), C226S, C229S (McEarchern et al., (2007) Blood, 109:1185-1192), P238S (Davis et al., (2007) J Rheumatol, 34:2204-2210), E233P, L234V (McEarchern et al., (2007) Blood, 109:1185-1192), P238A, A327Q, A327G, P329A (Shields R L. et al., (2001) J Bioi Chern. 276(9): 6591-604), K322A, L234F, L235E (Hezareh, et al., (2001) J Viral 75, 12161-12168; Oganesyan et al., (2008). Acta Crystallographica 64, 700-704), P331S (Oganesyan et al., (2008) Acta Crystallographica 64, 700-704), T394D (Wilkinson et al. (2013) MAbs 5(3): 406-417), A330L, M252Y, S254T, and/or T256E, where the amino acid position is according to the EU or Kabat numbering convention. In certain embodiments, the Fc region further includes an amino acid deletion at a position corresponding to glycine 236 according to the EU or Kabat numbering convention.

In some embodiments, the antibody has an IgG1 isotype with a heavy chain constant region that contains a C220S mutation according to the EU or Kabat numbering convention.

In some embodiments, the Fc region contains one or more mutations selected from L234F, L235E, P331S, D265A, and/or N297Q, according to EU or Kabat numbering convention. In some embodiments, the Fc region contains one or more mutations selected from L234A, L235A, D265A, P329A, N297A, N297Q according to EU or Kabat numbering convention.

In certain embodiments, the antibody has an IgG2 isotype. In some embodiments, the antibody contains a human IgG2 constant region. In some embodiments, the human IgG2 constant region includes an Fc region. In some embodiments, the Fc region contains one or more modifications. For example, in some embodiments, the Fc region contains one or more mutations (e.g., relative to a wild-type Fc region of the same isotype). In some embodiments, the one or more mutations are selected from V234A, G237A, P238S, H268A, H268E, H268Q, V309L, N297A, N297Q, V309L, A330S, P331S, C232S, C233S, M252Y, S254T, and/or T256E, where the amino acid position is according to the EU or Kabat numbering convention.

In certain embodiments, the antibody has an IgG4 isotype. In some embodiments, the antibody contains a human IgG4 constant region. In some embodiments, the human IgG4 constant region includes an Fc region. In some embodiments, the Fc region contains one or more modifications. For example, in some embodiments, the Fc region contains one or more mutations (e.g., relative to a wild-type Fc region of the same isotype). In some embodiments, the one or more mutations are selected from E233P, F234V, L234A, L235A, G237A, E318A (Hutchins et al. (1995) Proc Natl Acad Sci USA, 92:11980-11984), S228P, L236E, S241P, L248E (Reddy et al., (2000) J Immunol, 164:1925-1933; Angal et al., (1993) Mol Immunol. 30(1):105-8; U.S. Pat. No. 8,614, 299 B2), T394D, M252Y, S254T, T256E, N297A, and/or N297Q, where the amino acid position is according to the EU or Kabat numbering convention.

In some embodiments, the Fc region further contains one or more additional mutations selected from a M252Y, S254T, and/or T256E, where the amino acid position is according to the EU or Kabat numbering convention.

In some embodiments, one or more of the IgG1 variants described herein may be combined with an A330L mutation (Lazar et al., (2006) Proc Natl Acad Sci USA, 103:4005-4010), or one or more of L234F, L235E, and/or P331S mutations (Sazinsky et al., (2008) Proc Natl Acad Sci USA, 105:20167-20172), where the amino acid position is according to the EU or Kabat numbering convention, to eliminate complement activation. In some embodiments, the IgG variants described herein may be combined with one or more mutations to enhance the antibody half-life in human serum (e.g. M252Y, S254T, T256E mutations according to the EU or Kabat numbering convention) (Dall'Acqua et al., (2006) J Biol Chem, 281:23514-23524; and Strohl et al., (2009) Current Opinion in Biotechnology, 20:685-691).

In some embodiments, an IgG4 variant of the present disclosure may be combined with an S228P mutation according to the EU or Kabat numbering convention (Angal et al., (1993) Mol Immunol, 30:105-108) and/or with one or more mutations described in Peters et al., (2012) J Biol Chem. 13; 287(29):24525-33) to enhance antibody stabilization.

In some embodiments, the antibody has an Fc region selected from an IgG2 Fc region, an IgG4 Fc region, or an IgG2/IgG4 hybrid Fc region.

Camelid Antibodies

Antibody proteins obtained from members of the camel and dromedary (*Camelus bactrianus* and *Calelus dromaderius*) family including new world members such as llama species (*Lama paccos, Lama glama* and *Lama vicugna*) have been characterized with respect to size, structural complexity and antigenicity for human subjects. Certain IgG antibodies from this family of mammals as found in nature lack light chains, and are thus structurally distinct from the typical four chain quaternary structure having two heavy and two light chains, for antibodies from other animals. See PCT/EP93/02214 (WO 94/04678 published 3 Mar. 1994).

A region of the camelid antibody which is the small single variable domain identified as VHH can be obtained by genetic engineering to yield a small protein having high affinity for a target, resulting in a low molecular weight antibody-derived protein known as a "camelid nanobody." See U.S. Pat. No. 5,759,808 issued Jun. 2, 1998; see also Stijlemans, B. et al., 2004 J Biol Chem 279: 1256-1261; Dumoulin, M. et al., 2003 Nature 424: 783-788; Pleschberger, M. et al. 2003 Bioconjugate Chem 14: 440-448; Cortez-Retamozo, V. et al. 2002 Int J Cancer 89: 456-62; and Lauwereys, M. et al. 1998 EMBO J 17: 3512-3520. Engineered libraries of camelid antibodies and antibody fragments are commercially available, for example, from Ablynx, Ghent, Belgium. As with other antibodies and antigen-binding fragments thereof of non-human origin, an amino acid sequence of a camelid antibody can be altered recombinantly to obtain a sequence that more closely resembles a human sequence, i.e., the nanobody can be "humanized." Thus the natural low antigenicity of camelid antibodies to humans can be further reduced.

The camelid nanobody has a molecular weight approximately one-tenth that of a human IgG molecule, and the protein has a physical diameter of only a few nanometers. One consequence of the small size is the ability of camelid nanobodies to bind to antigenic sites that are functionally invisible to larger antibody proteins, i.e., camelid nanobodies are useful as reagents detect antigens that are otherwise cryptic using classical immunological techniques, and as possible therapeutic agents. Thus yet another consequence of small size is that a camelid nanobody can inhibit as a result of binding to a specific site in a groove or narrow cleft of a target protein, and hence can serve in a capacity that more closely resembles the function of a classical low molecular weight drug than that of a classical antibody.

The low molecular weight and compact size further result in camelid nanobodies being extremely thermostable, stable to extreme pH and to proteolytic digestion, and poorly antigenic. Another consequence is that camelid nanobodies readily move from the circulatory system into tissues, and even cross the blood-brain barrier and can treat disorders that affect nervous tissue. Nanobodies can further facilitated drug transport across the blood brain barrier. See U.S. patent application 20040161738 published Aug. 19, 2004. These features combined with the low antigenicity to humans indicate great therapeutic potential. Further, these molecules can be fully expressed in prokaryotic cells such as *E. coli* and are expressed as fusion proteins with bacteriophage and are functional.

Accordingly, a feature of the present invention is a camelid antibody or nanobody having high affinity for ENTPD2. In one embodiment herein, the camelid antibody or nanobody is naturally produced in the camelid animal, i.e., is produced by the camelid following immunization with ENTPD2 or a peptide fragment thereof, using techniques described herein for other antibodies. Alternatively, the ENTPD2-binding camelid nanobody is engineered, i.e., produced by selection for example from a library of phage displaying appropriately mutagenized camelid nanobody proteins using panning procedures with ENTPD2 as a target as described in the examples herein. Engineered nanobodies can further be customized by genetic engineering to have a half life in a recipient subject of from 45 minutes to two weeks. In a specific embodiment, the camelid antibody or nanobody is obtained by grafting the CDRs sequences of the heavy or light chain of the human antibodies of the invention into nanobody or single domain antibody framework sequences, as described for example in PCT/EP93/02214.

Bispecific Molecules and Multivalent Antibodies

In another aspect, the present invention features bispecific or multispecific molecules comprising a ENTPD2-binding antibody, or a fragment thereof, of the invention. An antibody of the invention, or antigen-binding regions thereof, can be derivatized or linked to another functional molecule, e.g., another peptide or protein (e.g., another antibody or ligand for a receptor) to generate a bispecific molecule that binds to at least two different binding sites or target molecules. The antibody of the invention may in fact be derivatized or linked to more than one other functional molecule to generate multi-specific molecules that bind to more than two different binding sites and/or target molecules; such multi-specific molecules are also intended to be encompassed by the term "bispecific molecule" as used herein. To create a bispecific molecule of the invention, an antibody of the invention can be functionally linked (e.g., by chemical coupling, genetic fusion, noncovalent association or otherwise) to one or more other binding molecules, such as another antibody, antibody fragment, peptide or binding mimetic, such that a bispecific molecule results.

Accordingly, the present invention includes bispecific molecules comprising at least one first binding specificity for ENTPD2 and a second binding specificity for a second target epitope. For example, the second target epitope is another epitope of ENTPD2 different from the first target epitope.

Additionally, for the invention in which the bispecific molecule is multi-specific, the molecule can further include a third binding specificity, in addition to the first and second target epitope.

In one embodiment, the bispecific molecules of the invention comprise as a binding specificity at least one antibody, or an antibody fragment thereof, including, e.g., a Fab, Fab', F (ab')2, Fv, or a single chain Fv. The antibody may also be a light chain or heavy chain dimer, or any minimal fragment thereof such as a Fv or a single chain construct as described in Ladner et al. U.S. Pat. No. 4,946,778.

Diabodies are bivalent, bispecific molecules in which VH and VL domains are expressed on a single polypeptide chain, connected by a linker that is too short to allow for pairing between the two domains on the same chain. The VH and VL domains pair with complementary domains of another chain, thereby creating two antigen binding sites (see e.g., Holliger et al., 1993 Proc. Natl. Acad. Sci. USA 90:6444-6448; Poijak et al., 1994 Structure 2:1121-1123). Diabodies can be produced by expressing two polypeptide chains with either the structure VHA-VLB and VHB-VLA (VH-VL configuration), or VLA-VHB and VLB-VHA (VL-VH configuration) within the same cell. Most of them can be expressed in soluble form in bacteria. Single chain diabodies (scDb) are produced by connecting the two diabody-forming polypeptide chains with linker of approximately 15 amino acid residues (see Holliger and Winter, 1997 Cancer Immunol. Immunother., 45 (3-4):128-30; Wu et al., 1996 Immunotechnology, 2 (1):21-36). scDb can be expressed in bacteria in soluble, active monomeric form (see Holliger and Winter, 1997 Cancer Immunol. Immunother., 45 (34): 128-30; Wu et al., 1996 Immunotechnology, 2 (1):21-36; Pluckthun and Pack, 1997 Immunotechnology, 3 (2): 83-105; Ridgway et al., 1996 Protein Eng., 9 (7):617-21). A diabody can be fused to Fc to generate a "di-diabody" (see Lu et al., 2004 J. Biol. Chem., 279 (4):2856-65).

Other antibodies which can be employed in the bispecific molecules of the invention are murine, chimeric and humanized monoclonal antibodies.

The bispecific molecules of the present invention can be prepared by conjugating the constituent binding specificities, using methods known in the art. For example, each binding specificity of the bispecific molecule can be generated separately and then conjugated to one another. When the binding specificities are proteins or peptides, a variety of coupling or cross-linking agents can be used for covalent conjugation. Examples of cross-linking agents include protein A, carbodiimide, N-succinimidyl-5-acetyl-thioacetate (SATA), 5,5'-dithiobis (2-nitrobenzoic acid) (DTNB), o-phenylenedimaleimide (oPDM), N-succinimidyl-3-(2-pyridyldithio)propionate (SPDP), and sulfosuccinimidyl 4-(N-maleimidomethyl)cyclohaxane-1-carboxylate (sulfo-SMCC) (see e.g., Karpovsky et al., 1984 J. Exp. Med. 160:1686; Liu, M A et al., 1985 Proc. Natl. Acad. Sci. USA 82:8648). Other methods include those described in Paulus, 1985 Behring Ins. Mitt. No. 78, 118-132; Brennan et al., 1985 Science 229:81-83), and Glennie et al., 1987 J. Immunol. 139: 2367-2375). Conjugating agents are SATA and sulfo-SMCC, both available from Pierce Chemical Co. (Rockford, Ill.).

When the binding specificities are antibodies, they can be conjugated by sulfhydryl bonding of the C-terminus hinge regions of the two heavy chains. In a particularly embodiment, the hinge region is modified to contain an odd number of sulfhydryl residues, for example one, prior to conjugation.

Alternatively, both binding specificities can be encoded in the same vector and expressed and assembled in the same host cell. This method is particularly useful where the bispecific molecule is a mAb X mAb, mAb X Fab, Fab X F (ab')2 or ligand X Fab fusion protein. A bispecific molecule of the invention can be a single chain molecule comprising one single chain antibody and a binding determinant, or a single chain bispecific molecule comprising two binding determinants. Bispecific molecules may comprise at least two single chain molecules. Methods for preparing bispecific molecules are described for example in U.S. Pat. Nos. 5,260,203; 5,455,030; 4,881,175; 5,132,405; 5,091,513; 5,476,786; 5,013,653; 5,258,498; and 5,482,858.

Binding of the bispecific molecules to their specific targets can be confirmed by, for example, enzyme-linked immunosorbent assay (ELISA), radioimmunoassay (REA), FACS analysis, bioassay (e.g., growth inhibition), or Western Blot assay. Each of these assays generally detects the presence of protein-antibody complexes of particular interest by employing a labeled reagent (e.g., an antibody) specific for the complex of interest.

In another aspect, the present invention provides multivalent compounds comprising at least two identical or different antigen-binding portions of the antibodies and antigen-binding fragments thereof of the invention binding to ENTPD2. The antigen-binding portions can be linked together via protein fusion or covalent or noncovalent linkage. Alternatively, methods of linkage has been described for the bispecific molecules. Tetravalent compounds can be obtained for example by cross-linking antibodies and antigen-binding fragments thereof of the invention with an antibody or antigen-binding fragment that binds to the constant regions of the antibodies and antigen-binding fragments thereof of the invention, for example the Fc or hinge region.

Trimerizing domain are described for example in Borean patent EP 1 012 280B1. Pentamerizing modules are described for example in PCT/EP97/05897.

In some embodiments, the ENTPD2-binding antibodies or antigen binding fragments thereof are bispecific antibodies that recognize a first antigen and a second antigen. In some embodiments, the first antigen is human ENTPD2 or a naturally occurring variant thereof. In some embodiments, the second antigen may be a protein, lipid, polysaccharide, or glycolipid expressed on one or more tumor cells.

Antibodies with Extended Half Life

The present invention provides for antibodies that specifically bind to ENTPD2 (e.g., human ENTPD2 protein) and have an extended half-life in vivo.

Many factors may affect a protein's half life in vivo. For examples, kidney filtration, metabolism in the liver, degradation by proteolytic enzymes (proteases), and immunogenic responses (e.g., protein neutralization by antibodies and uptake by macrophages and dendritic cells). A variety of strategies can be used to extend the half life of the antibodies and antigen-binding fragments thereof of the present invention. For example, by chemical linkage to polyethylene glycol (PEG), reCODE PEG, antibody scaffold, polysialic acid (PSA), hydroxyethyl starch (HES), albumin-binding ligands, and carbohydrate shields; by genetic fusion to proteins binding to serum proteins, such as albumin, IgG, FcRn, and transferring; by coupling (genetically or chemically) to other binding moieties that bind to serum proteins, such as nanobodies, Fabs, DARPins, avimers, affibodies, and anticalins; by genetic fusion to rPEG, albumin, domain of albumin, albumin-binding proteins, and Fc; or by incorporation into nanocarriers, slow release formulations, or medical devices.

To prolong the serum circulation of antibodies in vivo, inert polymer molecules such as high molecular weight PEG can be attached to the antibodies or a fragment thereof with or without a multifunctional linker either through site-specific conjugation of the PEG to the N- or C-terminus of the antibodies or via epsilon-amino groups present on lysine residues. To pegylate an antibody, the antibody, antigen-binding fragment thereof, typically is reacted with polyethylene glycol (PEG), such as a reactive ester or aldehyde derivative of PEG, under conditions in which one or more PEG groups become attached to the antibody or antibody fragment. The pegylation can be carried out by an acylation reaction or an alkylation reaction with a reactive PEG molecule (or an analogous reactive water-soluble polymer). As used herein, the term "polyethylene glycol" is intended to encompass any one of the forms of PEG that have been used to derivatize other proteins, such as mono (C1-C10) alkoxy- or aryloxy-polyethylene glycol or polyethylene glycol-maleimide. In one embodiment, the antibody to be pegylated is an aglycosylated antibody. Linear or branched polymer derivatization that results in minimal loss of biological activity will be used. The degree of conjugation can be closely monitored by SDS-PAGE and mass spectrometry to ensure proper conjugation of PEG molecules to the antibodies. Unreacted PEG can be separated from antibody-PEG conjugates by size-exclusion or by ion-exchange chromatography. PEG-derivatized antibodies can be tested for binding activity as well as for in vivo efficacy using methods well-known to those of skill in the art, for example, by immunoassays described herein. Methods for pegylating proteins are known in the art and can be applied to the antibodies and antigen-binding fragments thereof of the invention. See for example, EP 0154316 by Nishimura et al. and EP 0401384 by Ishikawa et al.

Other modified pegylation technologies include reconstituting chemically orthogonal directed engineering technology (ReCODE PEG), which incorporates chemically specified side chains into biosynthetic proteins via a reconstituted system that includes tRNA synthetase and tRNA. This technology enables incorporation of more than 30 new amino acids into biosynthetic proteins in E. coli, yeast, and mammalian cells. The tRNA incorporates a normative amino acid any place an amber codon is positioned, converting the amber from a stop codon to one that signals incorporation of the chemically specified amino acid.

Recombinant pegylation technology (rPEG) can also be used for serum halflife extension. This technology involves genetically fusing a 300-600 amino acid unstructured protein tail to an existing pharmaceutical protein. Because the apparent molecular weight of such an unstructured protein chain is about 15-fold larger than its actual molecular weight, the serum halflife of the protein is greatly increased. In contrast to traditional PEGylation, which requires chemical conjugation and repurification, the manufacturing process is greatly simplified and the product is homogeneous.

Polysialytion is another technology, which uses the natural polymer polysialic acid (PSA) to prolong the active life and improve the stability of therapeutic peptides and proteins. PSA is a polymer of sialic acid (a sugar). When used for protein and therapeutic peptide drug delivery, polysialic acid provides a protective microenvironment on conjugation. This increases the active life of the therapeutic protein in the circulation and prevents it from being recognized by the immune system. The PSA polymer is naturally found in the human body. It was adopted by certain bacteria which evolved over millions of years to coat their walls with it. These naturally polysialylated bacteria were then able, by virtue of molecular mimicry, to foil the body's defense system. PSA can be easily produced from such bacteria in large quantities and with predetermined physical characteristics. Bacterial PSA is completely non-immunogenic, even when coupled to proteins, as it is chemically identical to PSA in the human body.

Another technology include the use of hydroxyethyl starch ("HES") derivatives linked to antibodies. HES is a modified natural polymer derived from waxy maize starch and can be metabolized by the body's enzymes. HES solutions are usually administered to substitute deficient blood volume and to improve the rheological properties of the blood. Hesylation of an antibody enables the prolongation of the circulation half-life by increasing the stability of the molecule, as well as by reducing renal clearance, resulting in an increased biological activity. By varying different parameters, such as the molecular weight of HES, a wide range of HES antibody conjugates can be customized.

Antibodies having an increased half-life in vivo can also be generated introducing one or more amino acid modifications (i.e., substitutions, insertions or deletions) into an IgG constant domain, or FcRn binding fragment thereof (preferably a Fc or hinge Fc domain fragment). See, e.g., International Publication No. WO 98/23289; International Publication No. WO 97/34631; and U.S. Pat. No. 6,277,375.

Further, antibodies can be conjugated to albumin in order to make the antibody or antibody fragment more stable in vivo or have a longer half life in vivo. The techniques are well-known in the art, see, e.g., International Publication Nos. WO 93/15199, WO 93/15200, and WO 01/77137; and European Patent No. EP 413,622.

The strategies for increasing half life is especially useful in nanobodies, fibronectin-based binders, and other antibodies or proteins for which increased in vivo half life is desired.

Antibody Conjugates

The present invention provides antibodies or antigen-binding fragments thereof that specifically bind to the extracellular domain of ENTPD2 (e.g., human ENTPD2 protein) recombinantly fused or chemically conjugated (including both covalent and non-covalent conjugations) to a heterologous protein or polypeptide (or antigen-binding fragment thereof, preferably to a polypeptide of at least 10, at least 20, at least 30, at least 40, at least 50, at least 60, at least 70, at least 80, at least 90 or at least 100 amino acids) to generate fusion proteins. In particular, the invention provides fusion proteins comprising an antigen-binding fragment of an antibody described herein (e.g., a Fab fragment, Fd fragment, Fv fragment, F (ab)$_2$ fragment, a VH domain, a VH CDR, a VL domain or a VL CDR) and a heterologous protein, polypeptide, or peptide. Methods for fusing or conjugating proteins, polypeptides, or peptides to an antibody or an antibody fragment are known in the art. See, e.g., U.S. Pat. Nos. 5,336,603, 5,622,929, 5,359,046, 5,349,053, 5,447,851, and 5,112,946; European Patent Nos. EP 307,434 and EP 367, 166; International Publication Nos. WO 96/04388 and WO 91/06570; Ashkenazi et al., 1991, Proc. Natl. Acad. Sci. USA 88: 10535-10539; Zheng et al., 1995, J. Immunol. 154:5590-5600; and Vil et al., 1992, Proc. Natl. Acad. Sci. USA 89:11337-11341.

Additional fusion proteins may be generated through the techniques of gene-shuffling, motif-shuffling, exon-shuffling, and/or codon-shuffling (collectively referred to as "DNA shuffling"). DNA shuffling may be employed to alter the activities of antibodies and antigen-binding fragments thereof of the invention (e.g., antibodies and antigen-binding fragments thereof with higher affinities and lower dissociation rates). See, generally, U.S. Pat. Nos. 5,605,793, 5,811,238, 5,830,721, 5,834,252, and 5,837,458; Patten et al., 1997, Curr. Opinion Biotechnol. 8:724-33; Harayama, 1998, Trends Biotechnol. 16 (2):76-82; Hansson, et al., 1999, J. Mol. Biol. 287:265-76; and Lorenzo and Blasco, 1998, Biotechniques 24 (2):308-313). Antibodies and antigen-binding fragments thereof, or the encoded antibodies and antigen-binding fragments thereof, may be altered by being subjected to random mutagenesis by error-prone PCR, random nucleotide insertion or other methods prior to recombination. A polynucleotide encoding an antibody antigen-binding fragment thereof that specifically binds to ENTPD2 (e.g., human ENTPD2 protein) may be recombined with one or more components, motifs, sections, parts, domains, fragments, etc. of one or more heterologous molecules.

Moreover, the antibodies and antigen-binding fragments thereof can be fused to marker sequences, such as a peptide to facilitate purification. In one embodiment, the marker amino acid sequence is a hexa-histidine peptide (SEQ ID NO: 1010), such as the tag provided in a pQE vector (QIAGEN, Inc., 9259 Eton Avenue, Chatsworth, Calif., 91311), among others, many one of which are commercially available. As described in Gentz et al., 1989, Proc. Natl. Acad. Sci. USA 86:821-824, for instance, hexa-histidine (SEQ ID NO: 1010) provides for convenient purification of the fusion protein. Other peptide tags useful for purification include, but are not limited to, the hemagglutinin ("HA") tag, which corresponds to an epitope derived from the influenza hemagglutinin protein (Wilson et al., 1984, Cell 37:767), and the "FLAG" tag.

In one embodiment, antibodies and antigen-binding fragments thereof of the present invention antigen-binding fragments thereof conjugated to a diagnostic or detectable agent. Such antibodies can be useful for monitoring or prognosing the onset, development, progression and/or severity of a disease or disorder as part of a clinical testing procedure, such as determining the efficacy of a particular therapy. Such diagnosis and detection can accomplished by coupling the antibody to detectable substances including, but not limited to, various enzymes, such as, but not limited to, horseradish peroxidase, alkaline phosphatase, beta-galactosidase, or acetylcholinesterase; prosthetic groups, such as, but not limited to, streptavidin/biotin and avidin/biotin; fluorescent materials, such as, but not limited to, umbelliferone, fluorescein, fluorescein isothiocynate, rhodamine, dichlorotriazinylamine fluorescein, dansyl chloride or phycoerythrin; luminescent materials, such as, but not limited to, luminol; bioluminescent materials, such as but not limited to, luciferase, luciferin, and aequorin; radioactive materials, such as, but not limited to, iodine (131I, 125I, 123I, and 121I), carbon (14C), sulfur (35S), tritium (3H), indium (115In, 113In, 112In, and 111In), technetium (99Tc), thallium (201Ti), gallium (68Ga, 67Ga), palladium (103Pd), molybdenum (99Mo), xenon (133Xe), fluorine (18F), 153Sm, 177Lu, 159Gd, 149 Pm, 140La, 175Yb, 166Ho, 90Y, 47Sc, 186Re, 188Re, 142Pr, 105Rh, 97Ru, 68Ge, 57Co, 65Zn, 85Sr, 32P, 153Gd, 169Yb, 51Cr, 54Mn, 75Se, 113Sn, and 117Tin; and positron emitting metals using various positron emission tomographies, and nonradioactive paramagnetic metal ions.

Further, an antibody antigen-binding fragment thereof may be conjugated to a therapeutic moiety or drug moiety. Therapeutic moieties or drug moieties are not to be construed as limited to classical chemical therapeutic agents. For example, the drug moiety may be a protein, peptide, or polypeptide possessing a desired biological activity. Such proteins may include, for example, a toxin such as abrin, ricin A, Pseudomonas exotoxin, cholera toxin, or diphtheria toxin; a protein such as tumor necrosis factor, alpha-interferon, beta-interferon, nerve growth factor, platelet derived growth factor, tissue plasminogen activator, an apoptotic agent, an anti-angiogenic agent; or, a biological response modifier such as, for example, a lymphokine.

Moreover, an antibody can be conjugated to therapeutic moieties such as a radioactive metal ion, such as alpha-emitters such as 213Bi or macrocyclic chelators useful for conjugating radiometal ions, including but not limited to, 131In, 131LU, 131Y, 131Ho, 131Sm, to polypeptides. In one embodiment, the macrocyclic chelator is 1,4,7,10-tetraazacyclododecane-N,N',N",N'''-tetraacetic acid (DOTA) which can be attached to the antibody via a linker molecule. Such linker molecules are commonly known in the art and described in Denardo et al., 1998, Clin Cancer Res. 4 (10):2483-90; Peterson et al., 1999, Bioconjug. Chem. 10 (4):553-7; and Zimmerman et al., 1999, Nucl. Med. Biol. 26 (8):943-50, each incorporated by reference in their entireties.

Techniques for conjugating therapeutic moieties to antibodies are well known, see, e.g., Amon et al., "Monoclonal Antibodies For Immunotargeting Of Drugs In Cancer Therapy," in Monoclonal Antibodies And Cancer Therapy, Reisfeld et al. (eds.), pp. 243-56 (Alan R. Liss, Inc. 1985); Hellstrom et al., "Antibodies For Drug Delivery", in Controlled Drug Delivery (2nd Ed.), Robinson et al. (eds.), pp. 623-53 (Marcel Dekker, Inc. 1987); Thorpe, "Antibody Carriers Of Cytotoxic Agents In Cancer Therapy: A Review", in Monoclonal Antibodies 84: Biological And Clinical Applications, Pinchera et al. (eds.), pp. 475-506 (1985); "Analysis, Results, And Future Prospective Of The Therapeutic Use Of Radiolabeled Antibody In Cancer Therapy", in Monoclonal Antibodies For Cancer Detection And Therapy, Baldwin et al. (eds.), pp. 303-16 (Academic Press 1985), and Thorpe et al., 1982, Immunol. Rev. 62:119-58.

Antibodies may also be attached to solid supports, which are particularly useful for immunoassays or purification of the target antigen. Such solid supports include, but are not limited to, glass, cellulose, polyacrylamide, nylon, polystyrene, polyvinyl chloride or polypropylene.

Nucleic Acids Encoding the Antibodies, Vectors and Host Cells

Also provided herein are nucleic acids encoding an antibody or antigen binding fragment thereof described herein. Such nucleic acids can encode polypeptides comprising segments or domains of the ENTPD2 antibodies or antigen-binding fragments thereof described above. Such nucleic acids or polynucleotides can encode at least one CDR region and usually all three CDR regions from the heavy or light chain of the ENTPD2 antibodies described herein. Such nucleic acids or polynucleotides can also encode all or substantially all of the variable region sequence of the heavy chain and/or the light chain of the ENTPD2 antibodies described herein. Such nucleic acids or polynucleotides can also encode both a variable region and a constant region of the antibody. Because of the degeneracy of the code, a variety of nucleic acid sequences will encode each of the immunoglobulin amino acid sequences. For example, the invention features a first and second nucleic acid encoding heavy and light chain variable regions, respectively, of an anti-human ENTPD2 antibody molecule chosen from one or more of the antibody molecules disclosed herein. The nucleic acid can comprise a nucleotide sequence as set forth in Table 1, or a sequence substantially identical thereto (e.g., a sequence having at least about 85%, 90%, 95%, or 99% sequence identity thereto, or which differs by no more than 3, 6, 15, 30, or 45 nucleotides from the sequences shown in Table 1).

In certain embodiments, the nucleic acid can comprise a nucleotide sequence encoding at least one, two, or three CDRs or hypervariable loops from a heavy chain variable region having an amino acid sequence as set forth in Table 1, or a sequence substantially homologous thereto (e.g., a sequence having at least about 85%, 90%, 95%, or 99% sequence identity thereto, and/or having one or more substitutions, e.g., conserved substitutions). In other embodiments, the nucleic acid can comprise a nucleotide sequence encoding at least one, two, or three CDRs or hypervariable loops from a light chain variable region having an amino acid sequence as set forth in Table 1, or a sequence substantially homologous thereto (e.g., a sequence having at least about 85%, 90%, 95%, or 99% sequence identity thereto, and/or having one or more substitutions, e.g., conserved substitutions). In yet another embodiment, the nucleic acid can comprise a nucleotide sequence encoding at least one, two, three, four, five, or six CDRs or hypervariable loops from heavy and light chain variable regions having an amino acid sequence as set forth in Table 1, or a sequence substantially homologous thereto (e.g., a sequence having at least about 85%, 90%, 95%, or 99% sequence identity thereto, and/or having one or more substitutions, e.g., conserved substitutions).

In certain embodiments, the nucleic acid can comprise a nucleotide sequence encoding at least one, two, or three CDRs or hypervariable loops from a heavy chain variable region having the nucleotide sequence as set forth in Table 1, a sequence substantially homologous thereto (e.g., a sequence having at least about 85%, 90%, 95%, or 99% sequence identity thereto). In another embodiment, the nucleic acid can comprise a nucleotide sequence encoding at least one, two, or three CDRs or hypervariable loops from a light chain variable region having the nucleotide sequence as set forth in Table 1, or a sequence substantially homologous thereto (e.g., a sequence having at least about 85%, 90%, 95%, or 99% sequence identity thereto) In yet another embodiment, the nucleic acid can comprise a nucleotide sequence encoding at least one, two, three, four, five, or six CDRs or hypervariable loops from heavy and light chain variable regions having the nucleotide sequence as set forth in Table 1, or a sequence substantially homologous thereto (e.g., a sequence having at least about 85%, 90%, 95%, or 99% sequence identity thereto).

The polynucleotide sequences can be produced by de novo solid-phase DNA synthesis or by PCR mutagenesis of an existing sequence encoding an ENTPD2-binding antibody or its binding fragment. Direct chemical synthesis of nucleic acids can be accomplished by methods known in the art, such as the phosphotriester method of Narang et al., 1979, Meth. Enzymol. 68:90; the phosphodiester method of Brown et al., Meth. Enzymol. 68:109, 1979; the diethylphosphoramidite method of Beaucage et al., Tetra. Lett., 22:1859, 1981; and the solid support method of U.S. Pat. No. 4,458,066. Introducing mutations to a polynucleotide sequence by PCR can be performed as described in, e.g., PCR Technology: Principles and Applications for DNA Amplification, H. A. Erlich (Ed.), Freeman Press, NY, N.Y., 1992; PCR Protocols: A Guide to Methods and Applications, Innis et al. (Ed.), Academic Press, San Diego, Calif., 1990; Mattila et al., Nucleic Acids Res. 19:967, 1991; and Eckert et al., PCR Methods and Applications 1:17, 1991.

Also provided herein are vectors (e.g., expression vectors) comprising a nucleic acid encoding a polypeptide comprising a segment or domain of the ENTPD2 antibodies or antigen-binding fragments thereof described herein. Such vectors can be employed to express and/or produce the ENTPD2-binding antibodies or antigen-binding fragments thereof. The term "expression vector" refers to a carrier nucleic acid molecule into which a desired coding sequence can be inserted for introduction into a cell where it can be expressed. The vector can be a DNA vector, a RNA vector, a plasmid, a cosmid, or a viral vector, or artificial chromosomes (see, e.g., Harrington et al., Nat Genet 15:345, 1997). For example, nonviral vectors useful for expression of the ENTPD2-binding antibodies or antigen-binding fragments thereof in mammalian (e.g., human) cells include pThioHis A, B & C, pcDNA3.1/His, pEBVHis A, B & C, (Invitrogen, San Diego, Calif.), MPSV vectors, and numerous other vectors known in the art for expressing proteins. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Useful viral vectors include vectors based on any one of the following viruses: retroviruses, lentiviruses, adenoviruses, adeno-associated viruses, herpes viruses (e.g., Herpes Simplex Virus (HSV)), vectors based on SV40, papilloma virus, HBP Epstein Barr virus, vaccinia virus, Sinbis virus, influenza virus, reovirus, Newcastle disease virus (NDV), measles virus, vesicular stomatitis virus (VSV), parvovirus, poliovirus, poxvirus, Seneca Valley virus, coxsackievirus, enterovirus, myxoma virus, maraba virus, or Semliki Forest virus (SFV). See, Brent et al., supra; Smith, Annu. Rev. Microbiol. 49:807, 1995; and Rosenfeld et al., Cell 68:143, 1992.

In some embodiments, the vector is a lentiviral vector. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity. A retroviral vector may also be, e.g., a gammaretroviral vector. A gammaretroviral vector may include, e.g., a promoter, a packaging signal (ψ), a primer binding site (PBS), one or more (e.g., two) long terminal repeats (LTR), and a transgene of interest, e.g., a gene encoding a CAR. A gammaretroviral vector may lack viral structural gens such as gag, pol, and env. Exemplary gammaretroviral vectors include Murine Leukemia Virus (MLV), Spleen-Focus Forming Virus (SFFV), and Myeloproliferative Sarcoma Virus (MPSV), and vectors derived therefrom. Other gammaretroviral vectors are described, e.g., in Tobias Maetzig et al., "Gammaretroviral Vectors: Biology, Technology and Application" Viruses. 2011 June; 3(6): 677-713.

In some embodiments, the vector is an adeno-associated virus (AAV) vector, e.g., a recombinant AAV (rAAV) vector. "AAV" is an abbreviation for adeno-associated virus, and may be used to refer to the virus itself or derivatives thereof. The term covers all subtypes and both naturally occurring and recombinant forms, except where required otherwise. The abbreviation "rAAV" refers to recombinant adeno-associated virus, also referred to as a recombinant AAV vector (or "rAAV vector"). The term "AAV" includes, for example, AAV type 1 (AAV1), AAV type 2 (AAV2), AAV type 3 (AAV3), AAV type 4 (AAV4), AAV type 5 (AAV5), AAV type 6 (AAV6), AAV type 7 (AAV7), AAV type 8 (AAV8), AAV type 9 (AAV9), AAV type 10 (AAV10, including AAVrh10), AAV type 12 (AAV12), avian AAV, bovine AAV, canine AAV, equine AAV, primate AAV, non-primate AAV, and ovine AAV. "Primate AAV" refers to AAV that infect primates, "non-primate AAV" refers to AAV that infect non-primate mammals, "bovine AAV" refers to AAV that infect bovine mammals, and so on.

The genomic sequences of various serotypes of AAV, as well as the sequences of the native inverted terminal repeats (ITRs), Rep proteins, and capsid subunits are known in the art. Such sequences may be found in the literature or in public databases such as GenBank. See, e.g., GenBank Accession NOs. NC-002077 (AAV1), AF063497 (AAV1), NC-001401 (AAV2), AF043303 (AAV2), NC-001729 (AAV3), NC-001829 (AAV4), U89790 (AAV4), NC-006152 (AAV5), AF513851 (AAV7), AF513852 (AAV8), and NC-006261 (AAV8); or in publications such as WO2005033321 (AAV1-9), the disclosures of which are incorporated by reference herein. See also, e.g., Srivistava et al. (1983) J. Virology 45:555; Chiorini et al. (1998) J. Virology 71:6823; Chiorini et al. (1999) J. Virology 73: 1309; Bantel-Schaal et al. (1999) J. Virology 73:939; Xiao et al. (1999) J. Virology 73:3994; Muramatsu et al. (1996) Virology 221:208; Shade et al., (1986) J. Virol. 58:921; Gao et al. (2002) Proc. Nat. Acad. Sci. USA 99: 11854; Moris et al. (2004) Virology 33:375-383; international patent publications WO 00/28061, WO 99/61601, WO 98/11244; and U.S. Pat. No. 6,156,303.

An "rAAV vector" as used herein refers to an AAV vector comprising a polynucleotide sequence not of AAV origin (i.e., a polynucleotide heterologous to AAV), typically a sequence of interest for the genetic transformation of a cell. In some embodiments, the heterologous polynucleotide may be flanked by at least one, and sometimes by two, AAV inverted terminal repeat (ITR) sequences. The term rAAV vector encompasses both rAAV vector particles and rAAV vector plasmids. An rAAV vector may either be single-stranded (ssAAV) or self-complementary (scAAV). An "AAV virus" or "AAV viral particle" or "rAAV vector particle" refers to a viral particle composed of at least one AAV capsid protein (typically by all of the capsid proteins of a wild-type AAV) and an encapsidated polynucleotide rAAV vector. If the particle comprises a heterologous polynucleotide (i.e., a polynucleotide other than a wild-type AAV genome such as a transgene to be delivered to a mammalian cell), it is typically referred to as an "rAAV vector particle" or simply an "rAAV vector." Thus, production of rAAV particle necessarily includes production of rAAV vector, as such a vector is contained within an rAAV particle.

In some embodiments, the vector can be a recombinant DNA molecule containing a nucleic acid encoding an antibody that binds to human ENTPD2 protein. "Recombinant" as used herein means that the vector, polynucleotide, polypeptide or cell is the product of various combinations of cloning, restriction or ligation steps (e.g. relating to a polynucleotide or polypeptide comprised therein), and/or other procedures that result in a construct that is distinct from a product found in nature. A recombinant virus or vector is a viral particle comprising a recombinant polynucleotide. The terms respectively include replicates of the original polynucleotide construct and progeny of the original virus construct.

The recombinant vector typically includes one or more regulatory sequences operatively linked to the nucleic acid sequence to be expressed. The term "regulatory sequence" includes promoters, enhancers, and other expression control elements (e.g., polyadenylation signals). Regulatory sequences include those which direct constitutive expression of a nucleotide sequence, as well as tissue-specific regulatory and/or inducible sequences. Expression vectors can also include elements designed to optimize messenger RNA stability and translatability in host cells, and/or drug selection markers for establishing permanent, stable cell clones expressing an antibody that binds to human ENTPD2 protein. The design of the expression vector can depend on such factors as the choice of the host cell to be transformed, the level of expression of protein desired, and the like. General methods for generating such recombinant expression vectors can be found in Sambrook and Russell eds. (2001) Molecular Cloning: A Laboratory Manual, 3rd edition; the series Ausubel et al. eds. (2007 with updated through 2010) Current Protocols in Molecular Biology, among others known in the art.

A "promoter" is a control sequence that is a region of a nucleic acid sequence at which initiation and rate of transcription are controlled. It may contain genetic elements at which regulatory proteins and molecules may bind such as RNA polymerase and other transcription factors. The phrases "operatively positioned", "operatively linked", "under control", and "under transcriptional control" mean that a promoter is in a correct functional location and/or orientation in relation to a nucleic acid sequence to control transcriptional initiation and/or expression of that sequence. A promoter may or may not be used in conjunction with an "enhancer", which refers to a cis-acting regulatory sequence involved in the transcriptional activation of a nucleic acid sequence.

A promoter may be one naturally-associated with a gene or sequence, as may be obtained by isolating the 5' non-coding sequences located upstream of the coding segment and/or exon. Such a promoter can be referred to as "endogenous". Similarly, an enhancer may be one naturally associated with a nucleic acid sequence, located either downstream or upstream of that sequence. Alternatively, certain advantages will be gained by positioning the coding nucleic acid segment under the control of a recombinant or heterologous promoter, which refers to a promoter that is not normally associated with a nucleic acid sequence in its natural environment. A recombinant or heterologous enhancer refers also to an enhancer not normally associated with a nucleic acid sequence in its natural environment. Such promoters or enhancers may include promoters or enhancers of other genes, and promoters or enhancers isolated from any other prokaryotic, viral, or eukaryotic cell, and promoters or enhancers not "naturally-occurring", i.e., containing different elements of different transcriptional regulatory regions and/or mutations that alter expression. In addition to producing nucleic acid sequences of promoters and enhancers synthetically, sequences may be produced using recombinant cloning and/or nucleic acid amplification technology, for example PCR, in connection with the compositions disclosed herein (see U.S. Pat. Nos. 4,683,202, 5,928,906). Furthermore, it is contemplated the control sequences that direct transcription and/or expression of sequences within non-nuclear organelles such as mitochondria, chloroplasts, and the like, can be employed as well.

The promoters employed can be constitutive, inducible, synthetic, tissue- or cell-specific, and/or useful under the appropriate conditions to direct high level expression of the introduced DNA segment, such as is advantageous in the large-scale production of recombinant proteins and/or peptides. In addition, other regulatory elements may also be incorporated to improve expression of a nucleic acid encoding an antibody that binds to human ENTPD2 protein, e.g., enhancers, ribosomal binding site, transcription termination sequences, and the like.

In some embodiments, a constitutive promoter is employed to provide constant expression of an anti-human ENTPD2 antibody. Examples of a constitutive promoter include, but not limited to, the immediate early cytomegalovirus (CMV) promoter, the simian virus 40 (SV40) early promoter, mouse mammary tumor virus (MMTV) promoter, human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the elongation factor-1α promoter, the hemoglobin promoter, and the creatine kinase promoter.

Inducible promoters are also contemplated as part of the present disclosure. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In some embodiments, a tissue- or cell-specific promoter is employed to provide expression of an anti-human ENTPD2 antibody only in specific tissues or cells. The identity of tissue- or cell-specific promoters or elements, as well as assays to characterize their activities, is well known to those of skill in the art. Examples include the human LIMK2 gene (Nomoto et al. 1999, Gene, 236(2):259-271), the somatostatin receptor 2 gene (Kraus et al., 1998, FEES Lett., 428(3): 165-170), murine epididymal retinoic acid-binding gene (Lareyre et al., 1999, J. Biol. Chem., 274(12): 8282-8290), human CD4 (Zhao-Emonet et al., 1998, Biochim. Biophys. Acta, 1442(2-3): 109-119), mouse alpha2 (XI) collagen (Tsumaki, et al., 1998, J. Biol. Chem., 273 (36):22861-22864), D1A dopamine receptor gene (Lee, et al., 1997, J. Auton. Nerv. Syst., 74(2-3):86-90), insulin-like growth factor II (Wu et al., 1997, Biochem. Biophys. Res. Commun., 233(1):221-226), human platelet endothelial cell adhesion molecule-1 (Almendro et al., 1996, J. Immunol., 157(12):5411-5421), muscle creatine kinase (MCK) promoter (Wang et al., Gene Ther. 2008 November; 15(22): 1489-99).

In some embodiments, a synthetic promoter is employed to provide expression of an anti-human ENTPD2 antibody. Synthetic promoters can greatly exceed the transcriptional potencies of natural promoters. For example, the synthetic promoters that do not get shut off or reduced in activity by the endogenous cellular machinery or factors can be selected. Other elements, including trans-acting factor binding sites and enhancers may be inserted into the synthetic promoter to improve transcriptional efficiency. Synthetic promoters can be rationally designed and chemically synthesized to combine the best features of both synthetic and biological promoters. Synthetic oligos are annealed and ligated through several processes to generate the full-length chemically synthesized promoter. Synthetic promoters can be inducible or cell-type specific promoters.

A specific initiation signal also may be required for efficient translation of coding sequences. These signals include the ATG initiation codon or adjacent sequences. Exogenous translational control signals, including the ATG initiation codon, may need to be provided. One of ordinary skill in the art would readily be capable of determining this and providing the necessary signals. It is well known that the initiation codon must be "in-frame" with the reading frame of the desired coding sequence to ensure translation of the entire insert. The exogenous translational control signals and initiation codons can be either natural or synthetic. The efficiency of expression may be enhanced by the inclusion of appropriate transcription enhancer elements.

Expression can employ any appropriate host cells known in the art, for example, mammalian host cells, bacterial host cells, yeast host cells, insect host cells, etc. Both prokaryotic and eukaryotic expression systems are widely available. In some embodiments, the expression system is a mammalian cell expression, such as a CHO cell expression system. In some embodiments, a nucleic acid may be codon-optimized to facilitate expression in a desired host cell. It will be important to employ a promoter and/or enhancer that effectively directs the expression of the DNA segment in the cell type, organelle, and organism chosen for expression. Those of skill in the art of molecular biology generally know the use of promoters, enhancers, and cell type combinations for protein expression, for example, see Sambrook et al. (2001).

Most transcribed eukaryotic RNA molecules will undergo RNA splicing to remove introns from the primary transcripts. Vectors containing genomic eukaryotic sequences may require donor and/or acceptor splicing sites to ensure proper processing of the transcript for protein expression (see Chandler et al., 1997, Proc. Natl. Acad. Sci. USA, 94(8):3596-601).

The vectors or constructs of the present disclosure will generally comprise at least one termination signal. A "termination signal" or "terminator" is comprised of the DNA sequences involved in specific termination of a RNA transcript by a RNA polymerase. Thus, in certain embodiments a termination signal that ends the production of a RNA transcript is contemplated. A terminator may be necessary in vivo to achieve desirable message levels. In eukaryotic systems, the terminator region may also comprise specific DNA sequences that permit site-specific cleavage of the new transcript so as to expose a polyadenylation site. This signals a specialized endogenous polymerase to add a stretch of about 200 A residues (poly A) to the 3' end of the transcript. RNA molecules modified with this polyA tail appear to more stable and are translated more efficiently. Thus, in other embodiments involving eukaryotes, it is preferred that the terminator comprises a signal for the cleavage of the RNA, and it is more preferred that the terminator signal promotes polyadenylation of the message. The terminator and/or polyadenylation site elements can serve to enhance message levels and/or to minimize read through from the cassette into other sequences. Terminators contemplated for use in the disclosure include any known terminator of transcription described herein or known to one of ordinary skill in the art, including but not limited to, for example, the termination sequences of genes, such as for example the bovine growth hormone terminator or viral termination sequences, such as for example the SV40 terminator. In certain embodiments, the termination signal may be a lack of transcribable or translatable sequence, such as due to a sequence truncation.

In expression, particularly eukaryotic expression, one will typically include a polyadenylation signal to effect proper polyadenylation of the transcript. The nature of the polyadenylation signal is not believed to be crucial to the successful practice of the disclosure, and/or any such sequence may be employed. Preferred embodiments include the SV40 polyadenylation signal and/or the bovine growth hormone polyadenylation signal, convenient and/or known to function well in various target cells. Polyadenylation may increase the stability of the transcript or may facilitate cytoplasmic transport.

To propagate a vector in a host cell, it may contain one or more origins of replication sites (often termed "ori"), which is a specific nucleic acid sequence at which replication is initiated. Alternatively an autonomously replicating sequence (ARS) can be employed if the host cell is yeast.

In certain embodiments of the disclosure, cells containing a nucleic acid construct of the present disclosure may be identified in vitro or in vivo by including a marker in the expression vector. Such markers would confer an identifiable change to the cell permitting easy identification of cells containing the expression vector. Generally, a selectable marker is one that confers a property that allows for selection. A positive selectable marker is one in which the presence of the marker allows for its selection, while a negative selectable marker is one in which its presence prevents its selection. An example of a positive selectable marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol are useful selectable markers. In addition to markers conferring a phenotype that allows for the discrimination of transformants based on the implementation of conditions, other types of markers including screenable markers such as GFP, whose basis is colorimetric analysis, are also contemplated. Alternatively, screenable enzymes such as herpes simplex virus thymidine kinase (HSV-tk) or chloramphenicol acetyltransferase (CAT) may be utilized. One of skill in the art would also know how to employ immunologic markers, possibly in conjunction with FACS analysis. The marker used is not believed to be important, so long as it is capable of being expressed simultaneously with the nucleic acid encoding a gene product. Further examples of selectable and screenable markers are well known to one of skill in the art.

The expression vectors may also provide a secretion signal sequence position to form a fusion protein with polypeptides encoded by inserted ENTPD2-binding antibody sequences. More often, the inserted ENTPD2-binding antibody sequences are linked to a signal sequences before inclusion in the vector. Vectors to be used to receive sequences encoding ENTPD2-binding antibody light and heavy chain variable domains sometimes also encode constant regions or parts thereof. Such vectors allow expression of the variable regions as fusion proteins with the constant regions thereby leading to production of intact antibodies and antigen-binding fragments thereof. Typically, such constant regions are human.

Generation of an expression vector can utilize a vector that includes a multiple cloning site (MCS), which is a nucleic acid region that contains multiple restriction enzyme sites, any one of which can be used in conjunction with standard recombinant technology to digest the vector. See Carbonelli et al., 1999, Levenson et al., 1998, and Cocea, 1997. "Restriction enzyme digestion" refers to catalytic cleavage of a nucleic acid molecule with an enzyme that functions only at specific locations in a nucleic acid molecule. Many one of these restriction enzymes are commercially available. Use of such enzymes is widely understood by those of skill in the art. Frequently, a vector is linearized or fragmented using a restriction enzyme that cuts within the MCS to enable exogenous sequences to be ligated to the vector. "Ligation" refers to the process of forming phosphodiester bonds between two nucleic acid fragments, which may or may not be contiguous with each other. Techniques involving restriction enzymes and ligation reactions are well known to those of skill in the art of recombinant technology.

Methods for introducing expression vectors containing the polynucleotide sequences of interest vary depending on the type of cellular host. For example, calcium chloride transfection is commonly utilized for prokaryotic cells, whereas calcium phosphate treatment or electroporation may be used for other cellular hosts (see generally Sambrook et al., supra). Other methods include, e.g., electroporation, calcium phosphate treatment, liposome-mediated transformation, injection and microinjection, ballistic methods/gene gun, virosomes, immunoliposomes, polycation: nucleic acid conjugates, naked DNA, artificial virions, fusion to the herpes virus structural protein VP22, agent-enhanced uptake of DNA, ex vivo transduction, protoplast fusion, retroviral transduction, viral transfection, lipid based transfection or other conventional techniques. In the case of protoplast fusion, the cells are grown in media and screened for the appropriate activity. For long-term, high-yield production of recombinant proteins, stable expression will often be desired. For example, cell lines which stably express polypeptides can be prepared using expression vectors which contain viral origins of replication or endogenous expression elements and a selectable marker gene. Following the introduction of the vector, cells may be allowed to grow for 1-2 days in an enriched media before they are switched to selective media. The purpose of the selectable marker is to confer resistance to selection, and its presence allows growth of cells which successfully express the introduced sequences in selective media. Resistant, stably transfected cells can be proliferated using tissue culture techniques appropriate to the cell type. Methods and conditions for culturing the resulting transfected cells and for recovering the antibody molecule produced are known to those skilled in the art, and may be varied or optimized depending upon the specific expression vector and mammalian host cell employed, based upon the present description.

Also provided herein are cells that include any one of the expression vectors described herein. In some embodiments, the disclosure features a host cell that includes a nucleic acid molecule described herein. Such cells can be a host cell or a therapeutic cell. The terms "host cell" and "recombinant host cell" are used interchangeably herein, which refer to not only to the particular subject cell but to the progeny or potential progeny of such a cell. Because certain modifications may occur in succeeding generations due to either mutation or environmental influences, such progeny may not, in fact, be identical to the parent cell, but are still included within the scope of the term as used herein.

In one embodiment, the host cells are genetically engineered to comprise nucleic acids encoding the antibody molecule. In one embodiment, the host cells are genetically engineered by using an expression cassette. The phrase "expression cassette" refers to nucleotide sequences, which are capable of effecting expression of a gene in hosts compatible with such sequences. Such cassettes may include a promoter, an open reading frame with or without introns, and a termination signal. Additional factors necessary or helpful in effecting expression may also be used, such as, for example, an inducible promoter.

The host cells for harboring and expressing the ENTPD2-binding antibody chains can be can be, but is not limited to, a eukaryotic cell or a prokaryotic cell, such as a bacterial cell, an insect cell, or a human cell. *E. coli* is one prokaryotic host useful for cloning and expressing the polynucleotides of the present invention. Other microbial hosts suitable for use include bacilli, such as *Bacillus subtilis*, and other enterobacteriaceae, such as *Salmonella, Serratia*, and various *Pseudomonas* species. In these prokaryotic hosts, one can also make expression vectors, which typically contain expression control sequences compatible with the host cell (e.g., an origin of replication). In addition, any number of a variety of well-known promoters will be present, such as the lactose promoter system, a tryptophan (trp) promoter system, a beta-lactamase promoter system, or a promoter system from phage lambda. The promoters typically control expression, optionally with an operator sequence, and have ribosome binding site sequences and the like, for initiating and completing transcription and translation. Other microbes, such as yeast, can also be employed to express ENTPD2-binding polypeptides of the invention. Insect cells in combination with baculovirus vectors can also be used. Suitable insect cells include, but are not limited to, Sf9 cells.

In one embodiment, mammalian host cells are used to express and produce the ENTPD2-binding antibodies of the present invention. For example, they can be either a hybridoma cell line expressing endogenous immunoglobulin genes (e.g., the 1D6.C9 myeloma hybridoma cell) or a mammalian cell line harboring an exogenous expression vector (e.g., the SP2/0 myeloma cell). These include any normal mortal or normal or abnormal immortal animal or human cell. For example, a number of suitable host cell lines capable of secreting intact immunoglobulins have been developed including the CHO cell lines, various Cos cell lines, HeLa cells, myeloma cell lines, transformed B-cells and hybridomas. The use of mammalian tissue cell culture to express polypeptides is discussed generally in, e.g., Winnacker, From Genes to Clones, VCH Publishers, N.Y., N.Y., 1987. Expression vectors for mammalian host cells can include expression control sequences, such as an origin of replication, a promoter, and an enhancer (see, e.g., Queen, et al., Immunol. Rev. 89:49-68, 1986), and necessary processing information sites, such as ribosome binding sites, RNA splice sites, polyadenylation sites, and transcriptional terminator sequences. These expression vectors usually contain promoters derived from mammalian genes or from mammalian viruses. Suitable promoters may be constitutive, cell type-specific, stage-specific, and/or modulatable or regulatable. Useful promoters include, but are not limited to, the metallothionein promoter, the constitutive adenovirus major late promoter, the dexamethasone-inducible MMTV promoter, the SV40 promoter, the MRP pol III promoter, the constitutive MPSV promoter, the tetracycline-inducible CMV promoter (such as the human immediate-early CMV promoter), the constitutive CMV promoter, and promoter-enhancer combinations known in the art.

A host cell can be used to produce or express an antibody that binds to human ENTPD2 protein. Accordingly, the disclosure also features methods for producing an antibody that binds to human ENTPD2 protein using a host cell. In one embodiment, the method includes culturing the host cell (into which a recombinant expression vector encoding the antibody has been introduced) in a suitable medium, such that the antibody that binds to human ENTPD2 protein is produced. In another embodiment, the method further includes isolating the antibody from the medium or the host cell. Suitable eukaryotic cells include, but are not limited to, Vero cells, HeLa cells, COS cells, CHO cells, HEK293 cells, BHK cells and MDCKII cells.

Producing Monoclonal Antibodies

Monoclonal antibodies (mAbs) can be produced by a variety of techniques, including conventional monoclonal antibody methodology, e.g., the standard somatic cell hybridization technique of Kohler and Milstein, 1975 Nature 256: 495. Many techniques for producing monoclonal antibody can be employed e.g., viral or oncogenic transformation of B lymphocytes.

An animal system for preparing hybridomas is the murine system. Hybridoma production in the mouse is a well established procedure. Immunization protocols and techniques for isolation of immunized splenocytes for fusion are known in the art. Fusion partners (e.g., murine myeloma cells) and fusion procedures are also known.

In some embodiments, the antibodies of the invention are humanized monoclonal antibodies. Chimeric or humanized antibodies and antigen-binding fragments thereof of the present invention can be prepared based on the sequence of a murine monoclonal antibody prepared as described above. DNA encoding the heavy and light chain immunoglobulins can be obtained from the murine hybridoma of interest and engineered to contain non-murine (e.g., human) immunoglobulin sequences using standard molecular biology techniques. For example, to create a chimeric antibody, the murine variable regions can be linked to human constant regions using methods known in the art (see e.g., U.S. Pat. No. 4,816,567 to Cabilly et al.). To create a humanized antibody, the murine CDR regions can be inserted into a human framework using methods known in the art. See e.g., U.S. Pat. No. 5,225,539 to Winter, and U.S. Pat. Nos. 5,530,101; 5,585,089; 5,693,762 and 6,180,370 to Queen et al.

In some embodiments, the antibodies of the invention are human monoclonal antibodies. Such human monoclonal antibodies directed against ENTPD2 can be generated using transgenic or transchromosomic mice carrying parts of the human immune system rather than the mouse system. These transgenic and transchromosomic mice include mice referred to herein as HuMAb mice and KM mice, respectively, and are collectively referred to herein as "human Ig mice".

The HuMAb Mouse® (Medarex, Inc.) contains human immunoglobulin gene miniloci that encode un-rearranged human heavy (mu and gamma) and kappa light chain immunoglobulin sequences, together with targeted mutations that inactivate the endogenous mu and kappa chain loci (see e.g., Lonberg, et al., 1994 Nature 368 (6474): 856-859). Accordingly, the mice exhibit reduced expression of mouse IgM or K, and in response to immunization, the introduced human heavy and light chain transgenes undergo class switching and somatic mutation to generate high affinity human IgG-kappa monoclonal (Lonberg, N. et al., 1994 supra; reviewed in Lonberg, N., 1994 Handbook of Experimental Pharmacology 113:49-101; Lonberg, N. and Huszar, D., 1995 Intern. Rev. Immunol. 13: 65-93, and Harding, F. and Lonberg, N., 1995 Ann. N.Y. Acad. Sci. 764:536-546). The preparation and use of HuMAb mice, and the genomic modifications carried by such mice, is further described in Taylor, L. et al., 1992 Nucleic Acids Research 20:6287-6295; Chen, J. et al., 1993 International Immunology 5: 647-656; Tuaillon et al., 1993 Proc. Natl. Acad. Sci. USA 94:3720-3724; Choi et al., 1993 Nature Genetics 4:117-123; Chen, J. et al., 1993 EMBO J. 12: 821-830; Tuaillon et al., 1994 J. Immunol. 152:2912-2920; Taylor, L. et al., 1994 International Immunology 579-591; and Fishwild, D. et al., 1996 Nature Biotechnology 14: 845-851. See further, U.S. Pat. Nos. 5,545,806; 5,569,825; 5,625,126; 5,633,425; 5,789,650; 5,877,397; 5,661,016; 5,814,318; 5,874,299; and 5,770,429; all to Lonberg and Kay; U.S. Pat. No. 5,545,807 to Surani et al.; PCT Publication Nos. WO 92103918, WO 93/12227, WO 94/25585, WO 97113852, WO 98/24884 and WO 99/45962, all to Lonberg and Kay; and PCT Publication No. WO 01/14424 to Korman et al.

In some embodiments, human antibodies can be raised using a mouse that carries human immunoglobulin sequences on transgenes and transchomosomes such as a mouse that carries a human heavy chain transgene and a human light chain transchromosome. Such mice, referred to herein as "KM mice," are described in detail in PCT Publication WO 02/43478 to Ishida et al.

Still further, alternative transgenic animal systems expressing human immunoglobulin genes are available in the art and can be used to raise ENTPD2-binding antibodies and antigen-binding fragments thereof. For example, an alternative transgenic system referred to as the Xenomouse (Abgenix, Inc.) can be used. Such mice are described in, e.g., U.S. Pat. Nos. 5,939,598; 6,075,181; 6,114,598; 6,150,584 and 6,162,963 to Kucherlapati et al.

Moreover, alternative transchromosomic animal systems expressing human immunoglobulin genes are available in the art and can be used to raise ENTPD2-binding antibodies of the invention. For example, mice carrying both a human heavy chain transchromosome and a human light chain transchromosome, referred to as "TC mice" can be used; such mice are described in Tomizuka et al., 2000 Proc. Natl. Acad. Sci. USA 97:722-727. Furthermore, cows carrying human heavy and light chain transchromosomes have been described in the art (Kuroiwa et al., 2002 Nature Biotechnology 20:889-894) and can be used to raise ENTPD2 binding antibodies of the invention.

Human monoclonal antibodies can also be prepared using phage display methods for screening libraries of human immunoglobulin genes. Such phage display methods for isolating human antibodies are established in the art or described in the examples below. See for example: U.S. Pat. Nos. 5,223,409; 5,403,484; and 5,571,698 to Ladner et al; U.S. Pat. Nos. 5,427,908 and 5,580,717 to Dower et al; U.S. Pat. Nos. 5,969,108 and 6,172,197 to McCafferty et al; and U.S. Pat. Nos. 5,885,793; 6,521,404; 6,544,731; 6,555,313; 6,582,915 and 6,593,081 to Griffiths et al.

Human monoclonal antibodies of the invention can also be prepared using SCID mice into which human immune cells have been reconstituted such that a human antibody response can be generated upon immunization. Such mice are described in, for example, U.S. Pat. Nos. 5,476,996 and 5,698,767 to Wilson et al.

Methods of Engineering Modified Antibodies

As discussed above, the ENTPD2-binding antibodies having VH and VL sequences or full length heavy and light chain sequences shown herein can be used to create new ENTPD2-binding antibodies by modifying full length heavy chain and/or light chain sequences, VH and/or VL sequences, or the constant region(s) attached thereto. Thus, in another aspect of the invention, the structural features of ENTPD2-binding antibody of the invention are used to create structurally related ENTPD2-binding antibodies that retain at least one functional property of the antibodies and antigen-binding fragments thereof of the invention, such as binding to and inhibit human ENTPD2.

For example, one or more CDR regions of the antibodies and antigen-binding fragments thereof of the present invention, or mutations thereof, can be combined recombinantly with known framework regions and/or other CDRs to create additional, recombinantly-engineered, ENTPD2-binding antibodies and antigen-binding fragments thereof of the invention, as discussed above. Other types of modifications include those described in the previous section. The starting material for the engineering method is one or more of the VH and/or VL sequences provided herein, or one or more CDR regions thereof. To create the engineered antibody, it is not necessary to actually prepare (i.e., express as a protein) an antibody having one or more of the VH and/or VL sequences provided herein, or one or more CDR regions thereof. Rather, the information contained in the sequence (s) is used as the starting material to create a "second generation" sequence(s) derived from the original sequence(s) and then the "second generation" sequence(s) is prepared and expressed as a protein.

The altered antibody sequence can also be prepared by screening antibody libraries having fixed CDR3 sequences or minimal essential binding determinants as described in US20050255552 and diversity on CDR1 and CDR2 sequences. The screening can be performed according to any screening technology appropriate for screening antibodies from antibody libraries, such as phage display technology.

Standard molecular biology techniques can be used to prepare and express the altered antibody sequence. The antibody encoded by the altered antibody sequence (s) is one that retains one, some or all of the functional properties of the ENTPD2-binding antibodies described herein, which functional properties include, but are not limited to, specifically binding to and stabilize human ENTPD2 protein.

The functional properties of the altered antibodies can be assessed using standard assays available in the art and/or described herein, such as those set forth in the Examples (e.g., ELISAs).

In some embodiments, the methods of engineering antibodies and antigen-binding fragments thereof of the invention, mutations can be introduced randomly or selectively along all or part of an ENTPD2-binding antibody coding sequence and the resulting modified ENTPD2-binding antibodies can be screened for binding activity and/or other functional properties as described herein. Mutational methods have been described in the art. For example, PCT Publication WO 02/092780 describes methods for creating and screening antibody mutations using saturation mutagenesis, synthetic ligation assembly, or a combination thereof. Alternatively, PCT Publication WO 03/074679 describes methods of using computational screening methods to optimize physiochemical properties of antibodies.

Characterization of the Antibodies

The antibodies and antigen-binding fragments thereof of the invention can be characterized by various functional assays. For example, they can be characterized by their ability to bind to the ENTPD2 protein (e.g., human ENTPD2 protein).

The ability of an antibody to bind to ENTPD2 (e.g., human ENTPD2 protein) can be detected by labelling the antibody of interest directly, or the antibody may be unlabeled and binding detected indirectly using various sandwich assay formats known in the art.

In some embodiments, the ENTPD2-binding antibodies and antigen-binding fragments thereof of the invention block or compete with binding of a reference ENTPD2-binding antibody to ENTPD2 protein (e.g., human ENTPD2 protein). These can be fully human or humanized ENTPD2-binding antibodies described above. They can also be other human, mouse, chimeric or humanized ENTPD2-binding antibodies which bind to the same epitope as the reference antibody. The capacity to block or compete with the reference antibody binding indicates that ENTPD2-binding antibody under test binds to the same or similar epitope as that defined by the reference antibody, or to an epitope which is sufficiently proximal to the epitope bound by the reference ENTPD2-binding antibody. Such antibodies are especially likely to share the advantageous properties identified for the reference antibody. The capacity to block or compete with the reference antibody may be determined by, e.g., a competition binding assay. With a competition binding assay, the antibody under test is examined for ability to inhibit specific binding of the reference antibody to a common antigen, such as ENTPD2 protein (e.g., human ENTPD2 protein). A test antibody competes with the reference antibody for specific binding to the antigen if an excess of the test antibody substantially inhibits binding of the reference antibody. Substantial inhibition means that the test antibody reduces specific binding of the reference antibody usually by at least 10%, 25%, 50%, 75%, or 90%.

There are a number of known competition binding assays that can be used to assess competition of an antibody with a reference antibody for binding to a particular protein, in this case, ENTPD2 (e.g., human ENTPD2 protein). These include, e.g., solid phase direct or indirect radioimmunoassay (RIA), solid phase direct or indirect enzyme immunoassay (EIA), sandwich competition assay (see Stahli et al., Methods in Enzymology 9:242-253, 1983); solid phase direct biotin-avidin EIA (see Kirkland et al., J. Immunol. 137:3614-3619, 1986); solid phase direct labeled assay, solid phase direct labeled sandwich assay (see Harlow & Lane, supra); solid phase direct label RIA using 1-125 label (see Morel et al., Molec. Immunol. 25:7-15, 1988); solid phase direct biotin-avidin EIA (Cheung et al., Virology 176:546-552, 1990); and direct labeled RIA (Moldenhauer et al., Scand. J. Immunol. 32:77-82, 1990). Typically, such an assay involves the use of purified antigen bound to a solid surface or cells bearing either of these, an unlabelled test ENTPD2-binding antibody and a labelled reference antibody. Competitive inhibition is measured by determining the amount of label bound to the solid surface or cells in the presence of the test antibody. Usually the test antibody is present in excess. Antibodies identified by competition assay (competing antibodies) include antibodies binding to the same epitope as the reference antibody and antibodies binding to an adjacent epitope sufficiently proximal to the epitope bound by the reference antibody for steric hindrance to occur.

To determine if the selected ENTPD2-binding monoclonal antibodies bind to unique epitopes, each antibody can be biotinylated using commercially available reagents (e.g., reagents from Pierce, Rockford, Ill.). Competition studies using unlabeled monoclonal antibodies and biotinylated monoclonal antibodies can be performed using ENTPD2 protein coated-ELISA plates. Biotinylated MAb binding can be detected with a strepavidin-alkaline phosphatase probe. To determine the isotype of a purified ENTPD2-binding antibody, isotype ELISA can be performed. For example, wells of microtiter plates can be coated with 1 µg/ml of anti-human IgG overnight at 4° C. After blocking with 1% BSA, the plates are reacted with 1 µg/ml or less of the monoclonal ENTPD2-binding antibody or purified isotype controls, at ambient temperature for one to two hours. The wells can then be reacted with either human IgG1 or human IgM-specific alkaline phosphatase-conjugated probes. Plates are then developed and analyzed so that the isotype of the purified antibody can be determined.

To demonstrate binding of monoclonal ENTPD2-binding antibodies to live cells expressing ENTPD2 protein (e.g., human ENTPD2 protein), flow cytometry can be used. Briefly, cell lines expressing ENTPD2 (grown under standard growth conditions) can be mixed with various concentrations of ENTPD2-binding antibody in PBS containing 0.1% BSA and 10% fetal calf serum, and incubated at 37° C. for 1 hour. After washing, the cells are reacted with fluorescein-labeled anti-human IgG antibody under the same conditions as the primary antibody staining. The samples can be analyzed by FACScan instrument using light and side scatter properties to gate on single cells. An alternative assay using fluorescence microscopy may be used (in addition to or instead of) the flow cytometry assay. Cells can be stained exactly as described above and examined by fluorescence microscopy. This method allows visualization of individual cells, but may have diminished sensitivity depending on the density of the antigen.

ENTPD2-binding antibodies and antigen-binding fragments thereof of the invention can be further tested for reactivity with ENTPD2 protein (e.g., human ENTPD2 protein) or antigenic fragment by Western blotting. Briefly, purified ENTPD2 protein (e.g., human ENTPD2 protein) or fusion proteins, or cell extracts from cells expressing ENTPD2 can be prepared and subjected to sodium dodecyl sulfate polyacrylamide gel electrophoresis. After electrophoresis, the separated antigens are transferred to nitrocellulose membranes, blocked with 10% fetal calf serum, and probed with the monoclonal antibodies to be tested. Human IgG binding can be detected using anti-human IgG alkaline phosphatase and developed with BCIP/NBT substrate tablets (Sigma Chem. Co., St. Louis, Mo.).

ENTPD2-binding antibodies and antigen-binding fragments thereof of the invention can be further tested for their abilities to modulate one or more ENTPD2 activities/functions.

ENTPD2-binding antibodies and antigen-binding fragments thereof of the invention can also be tested using any of the methods or assays described in the Examples.

Methods of Treatment and Therapeutic Use

The antibodies of the present invention have numerous in vitro and in vivo diagnostic and therapeutic utilities involving the diagnosis and treatment of disorders with ENTPD2-dependent pathophysiology. For example, these molecules can be administered to cells in culture, in vitro or ex vivo, or to human subjects, e.g., in vivo, to treat, prevent and to diagnose a variety disorders with ENTPD2-dependent pathophysiology. Accordingly, in one aspect provided herein are methods of treating a cancer in a subject in need thereof by administering to the subject a therapeutically effective amount of an antibody or antigen binding fragment thereof described herein, a nucleic acid encoding such an antibody or antigen binding fragment, a vector comprising a nucleic acid encoding such an antibody or antigen binding fragment, a cell comprising such a nucleic acid or vector, or a pharmaceutical composition comprising such an antibody or antigen binding fragment, nucleic acid, vector or cell. In one aspect, the invention provides a method of inhibiting or reducing growth of tumor cells in a subject comprising administering to the subject a therapeutically effective amount of an anti-human ENTPD2 antibody as disclosed herein.

In another aspect, a method of treating a subject, e.g., reducing or ameliorating, a hyperproliferative condition or disorder (e.g., a cancer), e.g., solid tumor, a hematological cancer, soft tissue tumor, or a metastatic lesion, in a subject is provided.

Accordingly, in one embodiment, the invention provides a method of inhibiting growth of tumor cells in a subject, comprising administering to the subject a therapeutically effective amount of one or more anti-human ENTPD2 antibody molecule or functional fragment thereof as described herein alone or in combination with other agents, e.g., therapeutic agents, or therapeutic modalities.

In some embodiments, such methods can further comprise a step of assaying expression levels of ENTPD2 in a sample obtained from a subject, e.g., tissue biopsy of the subject.

The term cancer is meant to include all types of cancerous growths or oncogenic processes, metastatic tissues or malignantly transformed cells, tissues, or organs, irrespective of histopathologic type or stage of invasiveness. Examples of cancerous disorders include, but are not limited to, solid tumors, soft tissue tumors, and metastatic lesions. Examples of solid tumors include malignancies, e.g., sarcomas, adenocarcinomas, and carcinomas, of the various organ systems, such as those affecting liver, lung, breast, lymphoid, gastrointestinal (e.g., colon), genitourinary tract (e.g., renal, urothelial cells), prostate and pharynx. Adenocarcinomas include malignancies such as most colon cancers, rectal cancer, renal-cell carcinoma, liver cancer (hepatocarcinoma, e.g., an advanced hepatocarcinoma, with or without a viral infection, e.g., a chronic viral hepatitis), non-small cell carcinoma of the lung, cancer of the small intestine and cancer of the esophagus. Squamous cell carcinomas include malignancies, e.g., in the lung, esophagus, skin, head and neck region, oral cavity, anus, and cervix.

Metastatic lesions of the aforementioned cancers can also be treated or prevented using the methods and compositions of the invention.

Exemplary cancers whose growth can be inhibited using the antibodies molecules disclosed herein include cancers typically responsive to immunotherapy. Non-limiting examples of preferred cancers for treatment include gastrointestinal cancer (e.g. gastric (stomach) cancer, colorectal cancer (CRC)), cancer of the esophagus (e.g. esophageal squamous cell carcinoma (ESCC)), pancreatic cancer, and cholangiocarcinoma. Additionally, refractory or recurrent malignancies can be treated using the antibody molecules described herein.

Examples of other cancers that can be treated include lung cancer (e.g., a non-small cell lung cancer (NSCLC) (e.g., a NSCLC with squamous and/or non-squamous histology, or a NSCLC adenocarcinoma)), a melanoma (e.g., an advanced melanoma), a renal cancer (e.g., a renal cell carcinoma, e.g., clear cell renal cell carcinoma), a liver cancer, a myeloma (e.g., a multiple myeloma), a prostate cancer, a breast cancer (e.g., a breast cancer that does not express one, two or all of estrogen receptor, progesterone receptor, or Her2/neu, e.g., a triple negative breast cancer), a pancreatic cancer, a head and neck cancer (e.g., head and neck squamous cell carcinoma (HNSCC), anal cancer, gastro-esophageal cancer, thyroid cancer, cervical cancer, a lymphoproliferative disease (e.g., a post-transplant lymphoproliferative disease) or a hematological cancer, T-cell lymphoma, a non-Hogdkin's lymphoma, or a leukemia (e.g., a myeloid leukemia), bone cancer, pancreatic cancer, skin cancer, cancer of the head or neck, cutaneous or intraocular malignant melanoma, uterine cancer, ovarian cancer, rectal cancer, anal cancer, gastro-esophageal cancer, stomach cancer, testicular cancer, uterine cancer, carcinoma of the fallopian tubes, carcinoma of the endometrium, carcinoma of the cervix, carcinoma of the vagina, carcinoma of the vulva, Hodgkin Disease, non-Hodgkin lymphoma, myeloma (e.g., multiple myeloma) cancer of the esophagus, cancer of the small intestine, cancer of the endocrine system, cancer of the thyroid gland, cancer of the parathyroid gland, cancer of the adrenal gland, sarcoma of soft tissue, cancer of the urethra, cancer of the penis, chronic or acute leukemias including acute myeloid leukemia, chronic myeloid leukemia, acute lymphoblastic leukemia, chronic lymphocytic leukemia, solid tumors of childhood, lymphocytic lymphoma, cancer of the bladder, cancer of the kidney (e.g. renal cancer, e.g., a renal cell carcinoma (RCC) (e.g., a metastatic RCC or clear cell renal cell carcinoma)), cancer of the ureter, carcinoma of the renal pelvis, neoplasm of the central nervous system (CNS), primary CNS lymphoma, tumor angiogenesis, spinal axis tumor, brain stem glioma, pituitary adenoma, Kaposi's sarcoma, epidermoid cancer, squamous cell cancer, T-cell lymphoma, environmentally induced cancers including those induced by asbestos, and combinations of said cancers.

In some embodiments, the therapies here can be used to treat a patient that has (or is identified as having) a cancer associated with an infection, e.g., a viral or bacterial infection. Exemplary cancers include cervical cancer, anal cancer, HPV-associated head and neck squamous cell cancer, HPV-associated esophageal papillomas, HHV6-associated lymphomas, EBV-associated lymphomas (including Burkitt lymphoma), Gastric MALT lymphoma, other infection-associated MALT lymphomas, HCC, and Kaposi's sarcoma.

In other embodiments, the cancer is a hematological malignancy or cancer including but is not limited to a leukemia or a lymphoma. For example, the anti-human ENTPD2 antibody molecule or a antigen-binding fragment thereof alone or in combination with other agents, e.g., therapeutic agents, can be used to treat cancers and malignancies including, but not limited to, e.g., acute leukemias including but not limited to, e.g., B-cell acute lymphoid leukemia ("BALL"), T-cell acute lymphoid leukemia ("TALL"), acute lymphoid leukemia (ALL); one or more chronic leukemias including but not limited to, e.g., chronic myelogenous leukemia (CML), chronic lymphocytic leukemia (CLL); additional hematologic cancers or hematologic conditions including, but not limited to, e.g., B cell prolymphocytic leukemia, blastic plasmacytoid dendritic cell neoplasm, Burkitt's lymphoma, diffuse large B cell lymphoma, Follicular lymphoma, Hairy cell leukemia, small cell- or a large cell-follicular lymphoma, malignant lymphoproliferative conditions, MALT lymphoma, mantle cell lymphoma, Marginal zone lymphoma, multiple myeloma, myelodysplasia and myelodysplastic syndrome, non-Hodgkin lymphoma, plasmablastic lymphoma, plasmacytoid dendritic cell neoplasm, Waldenstrom macroglobulinemia, and "preleukemia" which are a diverse collection of hematological conditions united by ineffective production (or dysplasia) of myeloid blood cells, and the like.

In one embodiment, the cancer is chosen from a colon cancer (e.g., colorectal cancer (CRC) or colorectal adenocarcinoma), gastric cancer (e.g., stomach adenocarcinoma, gastric carcinoma), esophageal cancer (e.g. esophageal squamous cell carcinoma (ESCC)), pancreatic cancer, cholangiocarcinoma, lung cancer (e.g., small cell lung cancer), breast cancer (e.g., breast adenocarcinoma) or ovarian cancer.

In one embodiment, the cancer is colorectal cancer (CRC) or colorectal adenocarcinoma.

In another embodiment, the cancer is gastric cancer.

In yet another embodiment, the cancer is esophageal squamous cell carcinoma (ESCC).

In yet another embodiment, the cancer is overexpressing ENTPD2 (ENTPD2 positive/ENTPD2+) such as ENTPD2+

CRC, ENTPD2+ stomach cancer (e.g. ENTPD2 gastric cancer), ENTPD2+ esophageal squamous cell carcinoma (ENTPD2+ ESCC).

The antibody or antigen binding fragment thereof described herein, the nucleic acid encoding such an antibody or antigen binding fragment, or the vector or cell comprising a nucleic acid encoding such an antibody or antigen binding fragment, or the pharmaceutical composition comprising such an antibody or antigen binding fragment, nucleic acid, vector, or cell, can be administered to the subject through an intravenous, intratumoral or subcutaneous route. In some embodiments, such an antibody or fragment thereof, nucleic acid, vector, cell, or pharmaceutical composition, is administered intravenously.

Also provided is an antibody or antigen binding fragment thereof described herein, a pharmaceutical composition comprising such an antibody or antigen binding fragment, a nucleic acid encoding such an antibody or antigen binding fragment, or a vector comprising a nucleic acid encoding such an antibody or antigen binding fragment, for use in the treatment of a cancer.

The present disclosure also includes uses of an antibody or antigen binding fragment thereof described herein, a pharmaceutical composition comprising such an antibody or antigen binding fragment, a nucleic acid encoding such an antibody or antigen binding fragment, or a vector comprising a nucleic acid encoding such an antibody or antigen binding fragment, in the manufacture of a medicament for treatment of a cancer.

Combination Therapies

The various treatments described above can be combined with another treatment. The present disclosure also relates to a pharmaceutical composition comprising a combination according to the disclosure described herein, in particular together with instructions for simultaneous, separate or sequential use (especially for being jointly active) thereof in the treatment of a cancer. For example, the ENTPD2 antibodies or antigen-binding fragments thereof described herein can be combined with one or more of standard of care treatment (e.g., for a cancer), another antibody molecule, an immunomodulator (e.g., an activator of a costimulatory molecule or an inhibitor of a coinhibitory molecule); a vaccine, e.g., a therapeutic cancer vaccine; or other forms of cell therapy, as described below.

Accordingly, the methods of treating a cancer described herein can further include administering at least one additional therapeutic agent to the subject in need of treatment. Also provided herein are methods of treating a cancer comprising administering at least two additional therapeutic agents to the subject in need of treatment.

The term "combination" refers to either a fixed combination in one dosage unit form, or a combined administration where a compound of the present invention and at least one combination partner (e.g. at least one other drug as explained below, also referred to as "therapeutic agent(s)" or "co-agent(s)") may be administered independently at the same time or separately within time intervals, especially where these time intervals allow that the combination partners show a cooperative, e.g. synergistic effect. The single components may be packaged in a kit or separately. One or both of the components (e.g., powders or liquids) may be reconstituted or diluted to a desired dose prior to administration. The terms "co-administration" or "combined administration" or the like as utilized herein are meant to encompass administration of the selected combination partner to a single subject in need thereof (e.g. a patient), and are intended to include treatment regimens in which the agents are not necessarily administered by the same route of administration or at the same time. The term "pharmaceutical combination" as used herein means a product that results from the mixing or combining of more than one therapeutic agent and includes both fixed and non-fixed combinations of the therapeutic agents. The term "fixed combination" means that the therapeutic agents, e.g. a compound of the present invention and a combination partner, are both administered to a patient simultaneously in the form of a single entity or dosage. The term "non-fixed combination" means that the therapeutic agents, e.g., a compound of the present invention and at least one combination partner, are administered to a patient as separate entities either simultaneously, concurrently or sequentially with no specific time limits, wherein such administration provides therapeutically effective levels of the at least two compounds in the body of the patient. The latter also applies to cocktail therapy, e.g. the administration of three or more therapeutic agents.

The term "pharmaceutical combination" as used herein refers to either a fixed combination in one dosage unit form, or non-fixed combination or a kit of parts for the combined administration where two or more therapeutic agents may be administered independently at the same time or separately within time intervals, especially where these time intervals allow that the combination partners show a cooperative, e.g. synergistic effect.

The term "combination therapy" refers to the administration of two or more therapeutic agents to treat a therapeutic condition or disorder described in the present disclosure. Such administration encompasses co-administration of these therapeutic agents in a substantially simultaneous manner, such as in a single capsule having a fixed ratio of active ingredients. Alternatively, such administration encompasses co-administration in multiple, or in separate containers (e.g., tablets, capsules, powders, and liquids) for each active ingredient. Powders and/or liquids may be reconstituted or diluted to a desired dose prior to administration. In addition, such administration also encompasses use of each type of therapeutic agent in a sequential manner, either at approximately the same time or at different times. In either case, the treatment regimen will provide beneficial effects of the drug combination in treating the conditions or disorders described herein.

The anti-human ENTPD2 antibody molecules can be used in combination with other therapies. For example, the combination therapy can include a composition of the present invention co-formulated with, and/or co-administered with, one or more additional therapeutic agents, e.g., one or more anti-cancer agents, cytotoxic or cytostatic agents, hormone treatment, vaccines, and/or other immunotherapies. In other embodiments, the antibody molecules are administered in combination with other therapeutic treatment modalities, including surgery, radiation, cryosurgery, and/or thermotherapy. Such combination therapies may advantageously utilize lower dosages of the administered therapeutic agents, thus avoiding possible toxicities or complications associated with the various monotherapies.

By "in combination with", it is not intended to imply that the therapy or the therapeutic agents must be administered at the same time and/or formulated for delivery together, although these methods of delivery are within the scope described herein.

The anti-human ENTPD2 antibody molecules can be administered concurrently with, prior to, or subsequent to, at least one or more other additional therapies or therapeutic agents. The anti-human ENTPD2 antibody molecule and the other at least one agent or therapeutic protocol can be administered in any order. In general, each agent will be administered at a dose and/or on a time schedule determined for that agent. It will further be appreciated that the at least one additional therapeutic agent utilized in this combination may be administered together in a single composition or administered separately in different compositions. In general, it is expected that additional therapeutic agents utilized in combination be utilized at levels that do not exceed the levels at which they are utilized individually. In some embodiments, the levels utilized in combination will be lower than those utilized individually.

The present disclosure thus inter alia pertains to a combination product for simultaneous, separate or sequential use, such as a combined preparation or a pharmaceutical fixed combination, or a combination of such preparation and combination.

Exemplary Adenosine A2A Receptor Antagonists

In certain embodiments, the anti-human ENTPD2 molecules described herein are administered in combination with at least one adenosine A2A receptor (A2AR) antagonist. In certain embodiments, the anti-human ENTPD2 molecules described herein are administered in combination with at least two adenosine A2A receptor (A2AR) antagonists. Exemplary A2AR antagonists include, but are not limited to, e.g., PBF509/NIR178 (Palobiofarma/Novartis), CPI444/V81444 (Corvus/Genentech), AZD4635/HTL-1071 (AstraZeneca/Heptares), Vipadenant (Redox/Juno), GBV-2034 (Globavir), AB928 (Arcus Biosciences), Theophylline, Istradefylline (Kyowa Hakko Kogyo), Tozadenant/SYN-115 (Acorda), KW-6356 (Kyowa Hakko Kogyo), ST-4206 (Leadiant Biosciences), and Preladenant/SCH 420814 (Merck/Schering).

In certain embodiments, the A2AR antagonist is PBF509/NIR178. PBF509/NIR178 and other A2AR antagonists are disclosed in U.S. Pat. No. 8,796,284 and WO 2017/025918, herein incorporated by reference in their entirety. In certain embodiments, the A2AR antagonist is 5-bromo-2,6-di-(1H-pyrazol-1-yl)pyrimidine-4-amine, or a pharmaceutically acceptable salt thereof. In certain embodiments, the A2AR antagonist has the following structure:

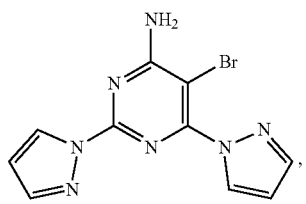 [SMILES: Nc1nc(-n2cccn2)nc(-n2cccn2)c1Br]

or a pharmaceutically acceptable salt thereof.

In certain embodiments, the A2AR antagonist is CPI444/V81444. CPI-444 and other A2AR antagonists are disclosed in WO 2009/156737, herein incorporated by reference in its entirety. In certain embodiments, the A2AR antagonist is (S)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof. In certain embodiments, the A2AR antagonist is (R)-7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a racemate thereof, or a pharmaceutically acceptable salt thereof. In certain embodiments, the A2AR antagonist is 7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof. In certain embodiments, the A2AR antagonist has the following structure:

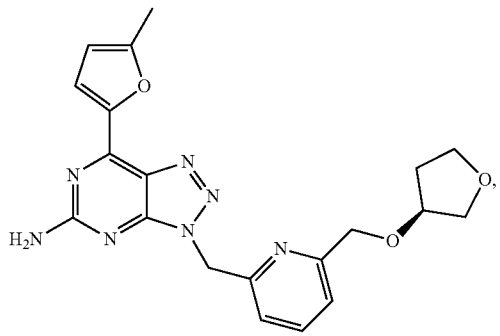 [SMILES: Cc1ccc(-c2nc(N)nc3c2nnn3Cc2cccc(CO[C@H]3CCOC3)n2)o1]

or a pharmaceutically acceptable salt thereof.

In certain embodiments, the A2AR antagonist is AZD4635/HTL-1071. A2AR antagonists are disclosed in WO 2011/095625, herein incorporated by reference in its entirety. In certain embodiments, the A2AR antagonist is 6-(2-chloro-6-methylpyridin-4-yl)-5-(4-fluorophenyl)-1,2,4-triazin-3-amine, or a pharmaceutically acceptable salt thereof. In certain embodiments, the A2AR antagonist has the following structure:

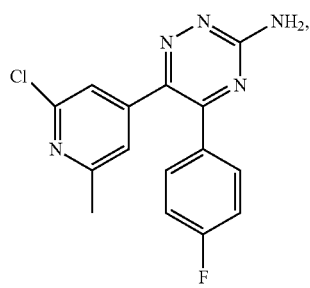 [SMILES: Cc1cc(-c2nnc(N)nc2-c2ccc(F)cc2)cc(Cl)n1]

or a pharmaceutically acceptable salt thereof.

In certain embodiments, the A2AR antagonist is ST-4206 (Leadiant Biosciences). In certain embodiments, the A2AR antagonist is an A2AR antagonist described in U.S. Pat. No. 9,133,197, herein incorporated by reference in its entirety. In certain embodiments, the A2AR antagonist has the following structure:

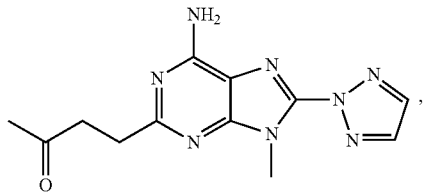 [SMILES: CC(=O)CCc1nc(N)c2nc(-n3nccn3)n(C)c2n1]

or a pharmaceutically acceptable salt thereof.

In certain embodiments, the A2AR antagonist is an A2AR antagonist described in U.S. Pat. Nos. 8,114,845, 9,029,393, US20170015758, or US20160129108, herein incorporated by reference in their entirety.

In certain embodiments, the A2AR antagonist is istradefylline (CAS Registry Number: 155270-99-8). Istradefylline is also known as KW-6002 or 8-[(E)-2-(3,4-dimethoxyphenyl)vinyl]-1,3-diethyl-7-methyl-3,7-dihydro-1H-purine-2,6-dione. Istradefylline is disclosed, e.g., in LeWitt et al. (2008) *Annals of Neurology* 63 (3): 295-302).

In certain embodiments, the A2aR antagonist is tozadenant (Biotie). Tozadenant is also known as SYN115 or 4-hydroxy-N-(4-methoxy-7-morpholin-4-yl-1,3-benzothiazol-2-yl)-4-methylpiperidine-1-carboxamide. Tozadenant blocks the effect of endogenous adenosine at the A2a receptors, resulting in the potentiation of the effect of dopamine at the D2 receptor and inhibition of the effect of glutamate at the mGluR5 receptor. In some embodiments, the A2aR antagonist is preladenant (CAS Registry Number: 377727-87-2). Preladenant is also known as SCH 420814 or 2-(2-Furanyl)-7-[2-[4-[4-(2-methoxyethoxy)phenyl]-1-piperazinyl]ethyl]7H-pyrazolo[4,3-e][1,2,4]triazolo[1,5-c]pyrimidine-5-amine. Preladenant was developed as a drug that acted as a potent and selective antagonist at the adenosine A2A receptor.

In certain embodiments, the A2aR antagonist is vipadenant. Vipadenant is also known as BIIB014, V2006, or 3-[(4-amino-3-methylphenyl)methyl]-7-(furan-2-yl)triazolo[4,5-d]pyrimidin-5-amine.

Other exemplary A2aR antagonists include, e.g., ATL-444, MSX-3, SCH-58261, SCH-412,348, SCH-442,416, VER-6623, VER-6947, VER-7835, CGS-15943, or ZM-241,385.

In some embodiments, the A2aR antagonist is an A2aR pathway antagonist, e.g., a CD-73 inhibitor, e.g., an anti-CD73 antibody. Targeting the extracellular production of adenosine by CD73 may reduce the immunosuppressive effects of adenosine. Anti-CD73 antibodies have a range of activities, e.g., inhibition of CD73 ectonucleotidase activity, relief from AMP-mediated lymphocyte suppression, and inhibition of syngeneic tumor growth. Anti-CD73 antibodies can drive changes in both myeloid and lymphoid infiltrating leukocyte populations within the tumor microenvironment. These changes include, e.g., increases in CD8 effector cells and activated macrophages, as well as a reduction in the proportions of myeloid-derived suppressor cells (MDSC) and regulatory T lymphocytes. In one embodiment, an anti-CD73 antibody molecule is a full antibody molecule or an antigen-binding fragment thereof. In some embodiments, the anti-CD73 antibody molecule is chosen from any of the antibody molecules listed in Table 2. In other embodiments, the anti-CD73 antibody molecule comprises a heavy chain variable domain sequence, a light chain variable domain sequence, or both, as disclosed in Table 2. In certain embodiments, the anti-CD73 antibody molecule binds to a CD73 protein and reduces, e.g., inhibits or antagonizes, an activity of CD73, e.g., human CD73.

In one embodiment, the anti-CD73 antibody molecule is an anti-CD73 antibody disclosed in WO2016/075099, herein incorporated by reference in its entirety. In one embodiment, the anti-CD73 antibody molecule is MEDI 9447, e.g., as disclosed in WO2016/075099. Alternative names for MEDI 9447 include clone 10.3 or 73combo3. MEDI 9447 is an IgG1 antibody that inhibits, e.g., antagonizes, an activity of CD73. MEDI 9447 and other anti-CD73 antibody molecules are also disclosed in WO2016/075176 and US2016/0129108, the entire contents of which are herein incorporated by reference in their entirety.

In one embodiment, the anti-CD73 antibody molecule comprises a heavy chain variable domain, a light chain variable domain, or both, of MEDI 9477. The amino acid sequence of the heavy chain variable domain of MEDI 9477 is disclosed as SEQ ID NO: 295 (see Table 2). The amino acid sequence of the light chain variable domain of MEDI 9477 is disclosed as SEQ ID NO: 296 (see Table 2).

In one embodiment, the anti-CD73 antibody molecule is an anti-CD73 antibody disclosed in WO2016/081748, herein incorporated by reference in its entirety. In one embodiment, the anti-CD73 antibody molecule is 11F11, e.g., as disclosed in WO2016/081748. 11F11 is an IgG2 antibody that inhibits, e.g., antagonizes, an activity of CD73. Antibodies derived from 11F11, e.g., CD73.4, and CD73.10; clones of 11F11, e.g., 11F11-1 and 11F11-2; and other anti-CD73 antibody molecules are disclosed in WO2016/081748 and U.S. Pat. No. 9,605,080, the entire contents of which are herein incorporated by reference in their entirety.

In one embodiment, the anti-CD73 antibody molecule comprises a heavy chain variable domain, a light chain variable domain, or both, of 11F11-1 or 11F11-2. The amino acid sequence of the heavy chain variable domain of 11F11-1 is disclosed as SEQ ID NO: 302 (see Table 2). The amino acid sequence of the light chain variable domain of 11F11-1 is disclosed as SEQ ID NO: 303 (see Table 2). The amino acid sequence of the heavy chain variable domain of 11F11-2 is disclosed as SEQ ID NO: 299 (see Table 2). The amino acid sequence of the light chain variable domain of 11F11-2 is disclosed as SEQ ID NO: 300 (see Table 2). In one embodiment, the anti-CD73 antibody molecule comprises a heavy chain, a light chain, or both, of 11F11-1 or 11F11-2. The heavy and light chain amino acid sequences of 11F11-1 are disclosed as SEQ ID NO: 297 and SEQ ID NO: 301, respectively (see Table 2). The heavy and light chain amino acid sequences of 11F11-2 are disclosed as SEQ ID NO: 294 and SEQ ID NO: 298, respectively (see Table 2).

In one embodiment, the anti-CD73 antibody molecule is an anti-CD73 antibody disclosed in e.g., U.S. Pat. No. 9,605,080, herein incorporated by reference in its entirety.

In one embodiment, the anti-CD73 antibody molecule is CD73.4, e.g., as disclosed in U.S. Pat. No. 9,605,080. In one embodiment, the anti-CD73 antibody molecule comprises a heavy chain variable domain, a light chain variable domain, or both, of CD73.4. The amino acid sequence of the heavy chain variable domain of CD73.4 is disclosed as SEQ ID NO: 304 (see Table 2). The amino acid sequence of the light chain variable domain of 11F11-2 is disclosed as SEQ ID NO: 305 (see Table 2).

In one embodiment, the anti-CD73 antibody molecule is CD73.10, e.g., as disclosed in U.S. Pat. No. 9,605,080. In one embodiment, the anti-CD73 antibody molecule comprises a heavy chain variable domain, a light chain variable domain, or both, of CD73.10. The amino acid sequence of the heavy chain variable domain of CD73.10 is disclosed as SEQ ID NO: 306 (see Table 2). The amino acid sequence of the light chain variable domain of CD73.10 is disclosed as SEQ ID NO: 307 (see Table 2).

In one embodiment, the anti-CD73 antibody molecule is an anti-CD73 antibody disclosed in WO2009/0203538, herein incorporated by reference in its entirety. In one embodiment, the anti-CD73 antibody molecule is 067-213, e.g., as disclosed in WO2009/0203538.

In one embodiment, the anti-CD73 antibody molecule comprises a heavy chain variable domain, a light chain variable domain, or both, of 067-213. The amino acid sequence of the heavy chain variable domain of 067-213 is disclosed as SEQ ID NO: 308 (see Table 2). The amino acid sequence of the light chain variable domain of 067-213 is disclosed as SEQ ID NO: 309 (see Table 2).

In one embodiment, the anti-CD73 antibody molecule is an anti-CD73 antibody disclosed in U.S. Pat. No. 9,090,697, herein incorporated by reference in its entirety. In one embodiment, the anti-CD73 antibody molecule is TY/23, e.g., as disclosed in U.S. Pat. No. 9,090,697. In one embodiment, the anti-CD73 antibody molecule comprises a heavy chain variable domain, a light chain variable domain, or both, of TY/23.

In one embodiment, the anti-CD73 antibody molecule is an anti-CD73 antibody disclosed in WO2016/055609, herein incorporated by reference in its entirety. In one embodiment, the anti-CD73 antibody molecule comprises a heavy chain variable domain, a light chain variable domain, or both, of an anti-CD73 antibody disclosed in WO2016/055609.

In one embodiment, the anti-CD73 antibody molecule is an anti-CD73 antibody disclosed in WO2016/146818, herein incorporated by reference in its entirety. In one embodiment, the anti-CD73 antibody molecule comprises a heavy chain variable domain, a light chain variable domain, or both, of an anti-CD73 antibody disclosed in WO2016/146818.

In one embodiment, the anti-CD73 antibody molecule is an anti-CD73 antibody disclosed in WO2004/079013, herein incorporated by reference in its entirety. In one embodiment, the anti-CD73 antibody molecule comprises a heavy chain variable domain, a light chain variable domain, or both, of an anti-CD73 antibody disclosed in WO2004/079013.

In one embodiment, the anti-CD73 antibody molecule is an anti-CD73 antibody disclosed in WO2012/125850, herein incorporated by reference in its entirety. In one embodiment, the anti-CD73 antibody molecule comprises a heavy chain variable domain, a light chain variable domain, or both, of an anti-CD73 antibody disclosed in WO2012/125850.

In one embodiment, the anti-CD73 antibody molecule is an anti-CD73 antibody disclosed in WO2015/004400, herein incorporated by reference in its entirety. In one embodiment, the anti-CD73 antibody molecule comprises a heavy chain variable domain, a light chain variable domain, or both, of an anti-CD73 antibody disclosed in WO2015/004400.

In one embodiment, the anti-CD73 antibody molecule is an anti-CD73 antibody disclosed in WO2007/146968, herein incorporated by reference in its entirety. In one embodiment, the anti-CD73 antibody molecule comprises a heavy chain variable domain, a light chain variable domain, or both, of an anti-CD73 antibody disclosed in WO2007146968.

In one embodiment, the anti-CD73 antibody molecule is an anti-CD73 antibody disclosed in US2007/0042392, herein incorporated by reference in its entirety. In one embodiment, the anti-CD73 antibody molecule comprises a heavy chain variable domain, a light chain variable domain, or both, of an anti-CD73 antibody disclosed in US2007/0042392.

In one embodiment, the anti-CD73 antibody molecule is an anti-CD73 antibody disclosed in US2009/0138977, herein incorporated by reference in its entirety. In one embodiment, the anti-CD73 antibody molecule comprises a heavy chain variable domain, a light chain variable domain, or both, of an anti-CD73 antibody disclosed in US2009/0138977.

In one embodiment, the anti-CD73 antibody molecule is an anti-CD73 antibody disclosed in Flocke et al., Eur J Cell Biol. 1992 June; 58(1):62-70, herein incorporated by reference in its entirety. In one embodiment, the anti-CD73 antibody molecule comprises a heavy chain variable domain, a light chain variable domain, or both, of an anti-CD73 antibody disclosed in Flocke et al., Eur J Cell Biol. 1992 June; 58(1):62-70.

In one embodiment, the anti-CD73 antibody molecule is an anti-CD73 antibody disclosed in Stagg et al., PNAS. 2010 January 107(4): 1547-1552, herein incorporated by reference in its entirety. In some embodiments, the anti-CD73 antibody molecule is TY/23 or TY11.8, as disclosed in Stagg et al. In one embodiment, the anti-CD73 antibody molecule comprises a heavy chain variable domain, a light chain variable domain, or both, of an anti-CD73 antibody disclosed in Stagg et al.

In one embodiment, the anti-human ENTPD2 antibody as described herein is administered in combination with an anti-CD73 antibody molecule, for example as described herein, and an A2AR antagonist, optionally selected from the group comprising PBF509/NIR178, CPI444/V81444, AZD4635/HTL-1071, Vipadenant, GBV-2034, AB928, Theophylline, Istradefylline, Tozadenant/SYN-115, KW-6356, ST-4206, and Preladenant/SCH 420814.

TABLE 2

| Sequences of exemplary anti-CD73 antibody molecules | |
|---|---|
| WO2016075099 MEDI 9447 | |
| SEQ ID NO: 295 VH | EVQLLESGGGLVQPGGSLRLSCAASGFTFSSYAYSWV RQAPGKGLEWVSAISGSGGRTYYADSVKGRFTISRDNS KNTLYLQMNSLRAEDTAVYYCARLGYGRVDEWGRG TLVTVSS |
| SEQ ID NO: 296 VL | QSVLTQPPSASGTPGQRVTISCSGSLSNIGRNPVNWYQ QLPGTAPKLLIYLDNLRLSGVPDRFSGSKSGTSASLAIS GLQSEDEADYYCATWDDSHPGWTFGGGTKLTVL |
| WO2016/081748 11F11-2 | |
| SEQ ID NO: 297 HC | QVQLVESGGGVVQPGRSLRLSCATSGFTFSNYGMHW VRQAPGKGLEWVAVILYDGSNKYYPDSVKGRFTISRD NSKNTLYLQMNSLRAEDTAVYYCARGGSSWYPDSFDI WGQGTMVTVSSASTKGPSVFPLAPCSRSTSESTAALGC LVKDYFPEPVTVSWNSGALTSGVHTFPAVLQSSGLYSL SSVVTVPSSNFGTQTYTCNVDHKPSNTKVDKTVERKC CVECPPCPAPPVAGPSVFLFPPKPKDTLMISRTPEVTCV VVDVSHEDPEVQFNWYVDGVEVHNAKTKPREEQFNS |

TABLE 2-continued

Sequences of exemplary anti-CD73 antibody molecules

|  |  |  |
|---|---|---|
|  |  | TFRVVSVLTVVHQDWLNGKEYKCKVSNKGLPAPIEKT<br>ISKTKGQPREPQVYTLPPSREEMTKNQVSLTCLVKGFY<br>PSDIAVEWESNGQPENNYKTTPPMLDSDGSFFLYSKLT<br>VDKSRWQQGNVFSCSVMHEALHNHYTQKSLSLSPGK |
| SEQ ID NO: 298 | LC | DIQMTQSPSSLSASVGDRVTITCRASQGISSWLAWYQQ<br>KPEKAPKSLIYAASSLQSGVPSRFSGSGSGTDFTLTISSL<br>QPEDFATYYCQQYNSYPLTFGGGTKVEIKRTVAAPSVF<br>IFPPSDEQLKSGTASVVCLLNNFYPREAKVQWKVDNA<br>LQSGNSQESVTEQDSKDSTYSLSSTLTLSKADYEKHKV<br>YACEVTHQGLSSPVTKSFNRGEC |
| SEQ ID NO: 299 | VH | QVQLVESGGGVVQPGRSLRLSCATSGFTFSNYGMHW<br>VRQAPGKGLEWVAVILYDGSNKYYPDSVKGRFTISRD<br>NSKNTLYLQMNSLRAEDTAVYYCARGGSSWYPDSFDI<br>WGQGTMVTVSS |
| SEQ ID NO: 300 | VL<br>kappa | DIQMTQSPSSLSASVGDRVTITCRASQGISSWLAWYQQ<br>KPEKAPKSLIYAASSLQSGVPSRFSGSGSGTDFTLTISSL<br>QPEDFATYYCQQYNSYPLTFGGGTKVEIK |

WO2016/081748
11F11-1

| SEQ ID NO: 297 | HC | QVQLVESGGGVVQPGRSLRLSCATSGFTFSNYGMHW<br>VRQAPGKGLEWVAVILYDGSNKYYPDSVKGRFTISRD<br>NSKNTLYLQMNSLRAEDTAVYYCARGGSSWYPDSFDI<br>WGQGTMVTVSSASTKGPSVFPLAPCSRSTSESTAALGC<br>LVKDYFPEPVTVSWNSGALTSGVHTFPAVLQSSGLYSL<br>SSVVTVPSSNFGTQTYTCNVDHKPSNTKVDKTVERKC<br>CVECPPCPAPPVAGPSVFLFPPKPKDTLMISRTPEVTCV<br>VVDVSHEDPEVQFNWYVDGVEVHNAKTKPREEQFNS<br>TFRVVSVLTVVHQDWLNGKEYKCKVSNKGLPAPIEKT<br>ISKTKGQPREPQVYTLPPSREEMTKNQVSLTCLVKGFY<br>PSDIAVEWESNGQPENNYKTTPPMLDSDGSFFLYSKLT<br>VDKSRWQQGNVFSCSVMHEALHNHYTQKSLSLSPGK |
|---|---|---|
| SEQ ID NO: 301 | LC | EIVLTQSPATLSLSPGERATLSCRASQGVSSYLAWYQQ<br>KPGQAPRLLIYDASNRATGIPARFSGSGPGTDFTLTISSL<br>EPEDFAVYYCQQRSNWHLTFGGGTKVEIKRTVAAPSV<br>FIFPPSDEQLKSGTASVVCLLNNFYPREAKVQWKVDN<br>ALQSGNSQESVTEQDSKDSTYSLSSTLTLSKADYEKHK<br>VYACEVTHQGLSSPVTKSFNRGEC |
| SEQ ID NO: 302 | VH | QVQLVESGGGVVQPGRSLRLSCATSGFTFSNYGMHW<br>VRQAPGKGLEWVAVILYDGSNKYYPDSVKGRFTISRD<br>NSKNTLYLQMNSLRAEDTAVYYCARGGSSWYPDSFDI<br>WGQGTMVTVSS |
| SEQ ID NO: 303 | VL<br>kappa | EIVLTQSPATLSLSPGERATLSCRASQGVSSYLAWYQQ<br>KPGQAPRLLIYDASNRATGIPARFSGSGPGTDFTLTISSL<br>EPEDFAVYYCQQRSNWHLTFGGGTKVEIK |

U.S. Pat. No. 9,605,080
CD73.4

| SEQ ID NO: 304 | VH | QVQLVESGGGVVQPGRSLRLSCAASGFTFSNYGMHW<br>VRQAPGKGLEWVAVILYDGSNKYYPDSVKGRFTISRD<br>NSKNTLYLQMNSLRAEDTAVYYCARGGSSWYPDSFDI<br>WGQGTMVTVSS |
|---|---|---|
| SEQ ID NO: 305 | VL<br>kappa | DIQMTQSPSSLSASVGDRVTITCRASQGISSWLAWYQQ<br>KPEKAPKSLIYAASSLQSGVPSRFSGSGSGTDFTLTISSL<br>QPEDFATYYCQQYNSYPLTFGGGTKVEIK |

U.S. Pat. No. 9,605,080
CD73.10

| SEQ ID NO: 306 | VH | QVQLVESGGGVVQPGRSLRLSCAASGFTFSNYGMHW<br>VRQAPGKGLEWVAVIWYDESNKYYPDSVKGRFTISRD<br>NSKNTLYLQMNSLRAEDTAVYYCARGGSSWYPDSFDI<br>WGQGTMVTVSS |
|---|---|---|
| SEQ ID NO: 307 | VL<br>kappa | DIQMTQSPSSLSASVGDRVTITCRASQGISSWLAWYQQ<br>KPEKAPKSLIYAASSLQSGVPSRFSGSGSGTDFTLTISSL<br>QPEDFATYYCQQYNSYPLTFGGGTKVEIK |

TABLE 2-continued

Sequences of exemplary anti-CD73 antibody molecules

U.S. Pat. No. 9,388,249
067-213

SEQ ID NO: 308 VH    EVQLVESGGGLVQPGRSLRLSCAASGFTFDDYAMHW
                     VRQAPGKGLEWVSGISWNSGSIGYADSVKGRFTISRDN
                     AKNSLYLQMNSLRAEDTALYYCVRSGSYNYYYGMD
                     VWGQGTTVTVSR

SEQ ID NO: 309 VL    QSVLTQPPSASGTPGQRVTISCSGSSSNIGSNTVNWYQ
                     QLPGTAPKLLIYSNNQRPSGVPDRFSGSKSGTSASLAIS
                     GLQSEDEADYYCAAWDDSLNGWVFGGGTKLTVLG

The anti-CD73 antibody molecules used in the combination therapies disclosed herein can include any of the VH/VL sequences disclosed in Table 2, or an amino acid sequence substantially identical thereto (e.g., at least 80%, 85%, 90%, 95%, 99% or more identical thereto). Exemplary sequences for CD73 antibodies include:

(i) the VH and VL amino acid sequences for MEDI 9447, SEQ ID NOs: 295-296, respectively, or an amino acid sequence substantially identical thereto (e.g., at least 80%, 85%, 90%, 95%, 99% or more identical to SEQ ID NOs: 295-296);

(ii) the HC and LC amino acid sequences for 11F11-2, SEQ ID NOs: 297-298, respectively, or an amino acid sequence substantially identical thereto (e.g., at least 80%, 85%, 90%, 95%, 99% or more identical to SEQ ID NOs: 297-298);

(iii) the VH and VL amino acid sequences for 11F11-2, SEQ ID NOs: 299-300, respectively, or an amino acid sequence substantially identical thereto (e.g., at least 80%, 85%, 90%, 95%, 99% or more identical to SEQ ID NOs: 299-300);

(iv) the HC and LC amino acid sequences for 11F11-1, SEQ ID NOs: 297 and 301, respectively, or an amino acid sequence substantially identical thereto (e.g., at least 80%, 85%, 90%, 95%, 99% or more identical to SEQ ID NOs: 297 and 301);

(v) the VH and VL amino acid sequences for 11F11-1, SEQ ID NOs: 302-303, respectively, or an amino acid sequence substantially identical thereto (e.g., at least 80%, 85%, 90%, 95%, 99% or more identical to SEQ ID NOs: 302-303);

(vi) the VH and VL amino acid sequences for CD73.4, SEQ ID NOs: 304-305, respectively, or an amino acid sequence substantially identical thereto (e.g., at least 80%, 85%, 90%, 95%, 99% or more identical to SEQ ID NOs: 304-305);

(vii) the VH and VL amino acid sequences for CD73.10, SEQ ID NOs: 306-307, respectively, or an amino acid sequence substantially identical thereto (e.g., at least 80%, 85%, 90%, 95%, 99% or more identical to SEQ ID NOs: 306-307); or (viii) the VH and VL amino acid sequences for 067-213, SEQ ID NOs: 308-309, respectively, or an amino acid sequence substantially identical thereto (e.g., at least 80%, 85%, 90%, 95%, 99% or more identical to SEQ ID NOs: 308-309).

The anti-human ENTPD2 antibody as described herein can be combined with an inhibitor of a co-inhibitory molecule (e.g., a PD-1 inhibitor (e.g., an anti-PD-1 antibody molecule), a PD-L1 inhibitor (e.g., an anti-PD-L1 antibody molecule), a PD-L2 inhibitor (e.g., an anti-PD-L2 antibody molecule), a LAG-3 inhibitor (e.g., an anti-LAG-3 antibody molecule), a TIM-3 inhibitor (e.g., an anti-TIM-3 antibody molecule)), an activator of a costimulatory molecule (e.g., a GITR agonist (e.g., an anti-GITR antibody molecule)), a cytokine (e.g., IL-15 complexed with a soluble form of IL-15 receptor alpha (IL-15Ra)), or any combination thereof.

PD-1 Inhibitors

In certain embodiments, the ENTPD2 antibody as described herein is administered in combination with a PD-1 inhibitor. In some embodiments, the PD-1 inhibitor is chosen from PDR001 (Novartis), Nivolumab (Bristol-Myers Squibb), Pembrolizumab (Merck & Co), Pidilizumab (CureTech), MEDI0680 (Medimmune), REGN2810 (Regeneron), TSR-042 (Tesaro), PF-06801591 (Pfizer), BGB-A317 (Beigene), BGB-108 (Beigene), INCSHR1210 (Incyte), or AMP-224 (Amplimmune).

Exemplary PD-1 Inhibitors

In one embodiment, the PD-1 inhibitor is an anti-PD-1 antibody molecule. In one embodiment, the PD-1 inhibitor is an anti-PD-1 antibody molecule as described in US 2015/0210769, published on Jul. 30, 2015, entitled "Antibody Molecules to PD-1 and Uses Thereof," incorporated by reference in its entirety.

In one embodiment, the anti-PD-1 antibody molecule comprises at least one, two, three, four, five or six complementarity determining regions (CDRs) (or collectively all of the CDRs) from a heavy and light chain variable region comprising an amino acid sequence shown in Table 3 (e.g., from the heavy and light chain variable region sequences of BAP049-Clone-E or BAP049-Clone-B disclosed in Table 3), or encoded by a nucleotide sequence shown in Table 3. In some embodiments, the CDRs are according to the Kabat definition (e.g., as set out in Table 3). In some embodiments, the CDRs are according to the Chothia definition (e.g., as set out in Table 3). In some embodiments, the CDRs are according to the combined CDR definitions of both Kabat and Chothia (e.g., as set out in Table 3). In one embodiment, the combination of Kabat and Chothia CDR of VH CDR1 comprises the amino acid sequence GYTFTTYWMH (SEQ ID NO: 541). In one embodiment, one or more of the CDRs (or collectively all of the CDRs) have one, two, three, four, five, six or more changes, e.g., amino acid substitutions (e.g., conservative amino acid substitutions) or deletions, relative to an amino acid sequence shown in Table 3, or encoded by a nucleotide sequence shown in Table 3.

In one embodiment, the anti-PD-1 antibody molecule comprises a heavy chain variable region (VH) comprising a VHCDR1 amino acid sequence of SEQ ID NO: 501, a VHCDR2 amino acid sequence of SEQ ID NO: 502, and a VHCDR3 amino acid sequence of SEQ ID NO: 503; and a light chain variable region (VL) comprising a VLCDR1 amino acid sequence of SEQ ID NO: 510, a VLCDR2 amino acid sequence of SEQ ID NO: 511, and a VLCDR3 amino acid sequence of SEQ ID NO: 512, each disclosed in Table 3.

In one embodiment, the antibody molecule comprises a VH comprising a VHCDR1 encoded by the nucleotide sequence of SEQ ID NO: 524, a VHCDR2 encoded by the nucleotide sequence of SEQ ID NO: 525, and a VHCDR3 encoded by the nucleotide sequence of SEQ ID NO: 526; and a VL comprising a VLCDR1 encoded by the nucleotide sequence of SEQ ID NO: 529, a VLCDR2 encoded by the nucleotide sequence of SEQ ID NO: 530, and a VLCDR3 encoded by the nucleotide sequence of SEQ ID NO: 531, each disclosed in Table 3.

In one embodiment, the anti-PD-1 antibody molecule comprises a VH comprising the amino acid sequence of SEQ ID NO: 506, or an amino acid sequence at least 85%, 90%, 95%, or 99% identical or higher to SEQ ID NO: 506. In one embodiment, the anti-PD-1 antibody molecule comprises a VL comprising the amino acid sequence of SEQ ID NO: 520, or an amino acid sequence at least 85%, 90%, 95%, or 99% identical or higher to SEQ ID NO: 520. In one embodiment, the anti-PD-1 antibody molecule comprises a VL comprising the amino acid sequence of SEQ ID NO: 516, or an amino acid sequence at least 85%, 90%, 95%, or 99% identical or higher to SEQ ID NO: 516. In one embodiment, the anti-PD-1 antibody molecule comprises a VH comprising the amino acid sequence of SEQ ID NO: 506 and a VL comprising the amino acid sequence of SEQ ID NO: 520. In one embodiment, the anti-PD-1 antibody molecule comprises a VH comprising the amino acid sequence of SEQ ID NO: 506 and a VL comprising the amino acid sequence of SEQ ID NO: 516.

In one embodiment, the antibody molecule comprises a VH encoded by the nucleotide sequence of SEQ ID NO: 507, or a nucleotide sequence at least 85%, 90%, 95%, or 99% identical or higher to SEQ ID NO: 507. In one embodiment, the antibody molecule comprises a VL encoded by the nucleotide sequence of SEQ ID NO: 521 or 517, or a nucleotide sequence at least 85%, 90%, 95%, or 99% identical or higher to SEQ ID NO: 521 or 517. In one embodiment, the antibody molecule comprises a VH encoded by the nucleotide sequence of SEQ ID NO: 507 and a VL encoded by the nucleotide sequence of SEQ ID NO: 521 or 517.

In one embodiment, the anti-PD-1 antibody molecule comprises a heavy chain comprising the amino acid sequence of SEQ ID NO: 508, or an amino acid sequence at least 85%, 90%, 95%, or 99% identical or higher to SEQ ID NO: 508. In one embodiment, the anti-PD-1 antibody molecule comprises a light chain comprising the amino acid sequence of SEQ ID NO: 522, or an amino acid sequence at least 85%, 90%, 95%, or 99% identical or higher to SEQ ID NO: 522. In one embodiment, the anti-PD-1 antibody molecule comprises a light chain comprising the amino acid sequence of SEQ ID NO: 518, or an amino acid sequence at least 85%, 90%, 95%, or 99% identical or higher to SEQ ID NO: 518. In one embodiment, the anti-PD-1 antibody molecule comprises a heavy chain comprising the amino acid sequence of SEQ ID NO: 508 and a light chain comprising the amino acid sequence of SEQ ID NO: 522. In one embodiment, the anti-PD-1 antibody molecule comprises a heavy chain comprising the amino acid sequence of SEQ ID NO: 508 and a light chain comprising the amino acid sequence of SEQ ID NO: 518.

In one embodiment, the antibody molecule comprises a heavy chain encoded by the nucleotide sequence of SEQ ID NO: 509, or a nucleotide sequence at least 85%, 90%, 95%, or 99% identical or higher to SEQ ID NO: 509. In one embodiment, the antibody molecule comprises a light chain encoded by the nucleotide sequence of SEQ ID NO: 523 or 519, or a nucleotide sequence at least 85%, 90%, 95%, or 99% identical or higher to SEQ ID NO: 523 or 519. In one embodiment, the antibody molecule comprises a heavy chain encoded by the nucleotide sequence of SEQ ID NO: 509 and a light chain encoded by the nucleotide sequence of SEQ ID NO: 523 or 519.

The antibody molecules described herein can be made by vectors, host cells, and methods described in US 2015/0210769, incorporated by reference in its entirety.

TABLE 3

Amino acid and nucleotide sequences of exemplary anti-PD-1 antibody molecules

| | | | |
|---|---|---|---|
| BAP049-Clone-B HC | | | |
| SEQ ID NO: 501 (Kabat) | | HCDR1 | TYWMH |
| SEQ ID NO: 502 (Kabat) | | HCDR2 | NIYPGTGGSNFDEKFKN |
| SEQ ID NO: 503 (Kabat) | | HCDR3 | WTTGTGAY |
| SEQ ID NO: 504 (Chothia) | | HCDR1 | GYTFTTY |
| SEQ ID NO: 505 (Chothia) | | HCDR2 | YPGTGG |
| SEQ ID NO: 503 (Chothia) | | HCDR3 | WTTGTGAY |
| SEQ ID NO: 506 | | VH | EVQLVQSGAEVKKPGESLRISCKGSGYTFTTYWMHWVRQATGQG LEWMGNIYPGTGGSNFDEKFKNRVTITADKSTSTAYMELSSLRSE DTAVYYCTRWTTGTGAYWGQGTTVTVSS |
| SEQ ID NO: 507 | | DNA VH | GAGGTGCAGCTGGTGCAGTCAGGCGCCGAAGTGAAGAAGCCCG GCGAGTCACTGAGAATTAGCTGTAAAGGTTCAGGCTACACCTT CACTACCTACTGGATGCACTGGGTCCGCCAGGCTACCGGTCAA GGCCTCGAGTGGATGGGTAATATCTACCCCGGCACCGGCGCT |

TABLE 3-continued

Amino acid and nucleotide sequences of exemplary anti-PD-1 antibody molecules

| | | |
|---|---|---|
| | | CTAACTTCGACGAGAAGTTTAAGAATAGAGTGACTATCACCGC<br>CGATAAGTCTACTAGCACCGCCTATATGGAACTGTCTAGCCTGA<br>GATCAGAGGACACCGCCGTCTACTACTGCACTAGGTGGACTAC<br>CGGCACAGGCGCCTACTGGGGTCAAGGCACTACCGTGACCGTG<br>TCTAGC |
| SEQ ID NO: 508 | Heavy<br>chain | EVQLVQSGAEVKKPGESLRISCKGSGYTFTTYWMHWVRQATGQG<br>LEWMGNIYPGTGGSNFDEKFKNRVTITADKSTSTAYMELSSLRSE<br>DTAVYYCTRWTTGTGAYWGQGTTVTVSSASTKGPSVFPLAPCSRS<br>TSESTAALGCLVKDYFPEPVTVSWNSGALTSGVHTFPAVLQSSGL<br>YSLSSVVTVPSSSLGTKTYTCNVDHKPSNTKVDKRVESKYGPPCPP<br>CPAPEFLGGPSVFLFPPKPKDTLMISRTPEVTCVVVDVSQEDPEVQF<br>NWYVDGVEVHNAKTKPREEQFNSTYRVVSVLTVLHQDWLNGKE<br>YKCKVSNKGLPSSIEKTISKAKGQPREPQVYTLPPSQEEMTKNQVS<br>LTCLVKGFYPSDIAVEWESNGQPENNYKTTPPVLDSDGSFFLYSRL<br>TVDKSRWQEGNVFSCSVMHEALHNHYTQKSLSLSLG |
| SEQ ID NO: 509 | DNA<br>heavy<br>chain | GAGGTGCAGCTGGTGCAGTCAGGCGCCGAAGTGAAGAAGCCCG<br>GCGAGTCACTGAGAATTAGCTGTAAAGGTTCAGGCTACACCTT<br>CACTACCTACTGGATGCACTGGGTCCGCCAGGCTACCGGTCAA<br>GGCCTCGAGTGGATGGGTAATATCTACCCCGGCACCGGCGGCT<br>CTAACTTCGACGAGAAGTTTAAGAATAGAGTGACTATCACCGC<br>CGATAAGTCTACTAGCACCGCCTATATGGAACTGTCTAGCCTGA<br>GATCAGAGGACACCGCCGTCTACTACTGCACTAGGTGGACTAC<br>CGGCACAGGCGCCTACTGGGGTCAAGGCACTACCGTGACCGTG<br>TCTAGCGCTAGCACTAAGGGCCCGTCCGTGTTCCCCCTGGCACC<br>TTGTAGCCGGAGCACTAGCGAATCCACCGCTGCCCTCGGCTGCC<br>TGGTCAAGGATTACTTCCCGGAGCCCGTGACCGTGTCCTGGAAC<br>AGCGGAGCCCTGACCTCCGGAGTGCACACCTTCCCGCTGTGCT<br>GCAGAGCTCCGGGCTGTACTCGCTGTCGTCGGTGGTCACGGTGC<br>CTTCATCTAGCCTGGGTACCAAGACCTACACTTGCAACGTGGAC<br>CACAAGCCTTCCAACACTAAGGTGGACAAGCGCGTCGAATCGA<br>AGTACGGCCCACCGTGCCCGCCTTGTCCCGCGCCGGAGTTCCTC<br>GGCGGTCCCTCGGTCTTTCTGTTCCCACCGAAGCCCAAGGACAC<br>TTTGATGATTTCCCGCACCCCTGAAGTGACATGCGTGGTCGTGG<br>ACGTGTCACAGGAAGATCCGGAGGTGCAGTTCAATTGGTACGT<br>GGATGGCGTCGAGGTGCACAACGCCAAAACCAAGCCGAGGGA<br>GGAGCAGTTCAACTCCACTTACCGCGTCGTGTCCGTGCTGACGG<br>TGCTGCATCAGGACTGGCTGAACGGGAAGGAGTACAAGTGCAA<br>AGTGTCCAACAAGGGACTTCCTAGCTCAATCGAAAAGACCATC<br>TCGAAAGCCAAGGGACAGCCCCGGGAACCCCAAGTGTATACCC<br>TGCCACCGAGCCAGGAAGAAATGACTAAGAACCAAGTCTCATT<br>GACTTGCCTTGTGAAGGGCTTCTACCCATCGGATATCGCCGTGG<br>AATGGGAGTCCAACGGCCAGCCGGAAAACAACTACAAGACCA<br>CCCCTCCGGTGCTGGACTCAGACGGATCCTTCTTCCTCTACTCG<br>CGGCTGACCGTGGATAAGAGCAGATGGCAGGAGGGAAATGTGT<br>TCAGCTGTTCTGTGATGCATGAAGCCCTGCACAACCACTACACT<br>CAGAAGTCCCTGTCCCTCTCCCTGGGA |

BAP049-Clone-B LC

| | | |
|---|---|---|
| SEQ ID NO: 510 (Kabat) | LCDR1 | KSSQSLLDSGNQKNFLT |
| SEQ ID NO: 511 (Kabat) | LCDR2 | WASTRES |
| SEQ ID NO: 512 (Kabat) | LCDR3 | QNDYSYPYT |
| SEQ ID NO: 513<br>(Chothia) | LCDR1 | SQSLLDSGNQKNF |
| SEQ ID NO: 514<br>(Chothia) | LCDR2 | WAS |
| SEQ ID NO: 515<br>(Chothia) | LCDR3 | DYSYPY |
| SEQ ID NO: 516 | VL | EIVLTQSPATLSLSPGERATLSCKSSQSLLDSGNQKNFLTWYQQKP<br>GKAPKLLIYWASTRESGVPSRFSGSGSGTDFTFTISSLQPEDIATYY<br>CQNDYSYPYTFGQGTKVEIK |
| SEQ ID NO: 517 | DNA VL | GAGATCGTCCTGACTCAGTCACCCGCTACCCTGAGCCTGAGCCC<br>TGGCGAGCGGGCTACACTGAGCTGTAAATCTAGTCAGTCACTG<br>CTGGATAGCGGTAATCAGAAGAACTTCCTGACCTGGTATCAGC<br>AGAAGCCCGGTAAAGCCCCTAAGCTGCTGATCTACTGGGCCTC<br>TACTAGAGAATCAGGCGTGCCCTCTAGGTTTAGCGGTAGCGGT<br>AGTGGCACCGACTTCACCTTCACTATCTCTAGCCTGCAGCCCGA |

TABLE 3-continued

Amino acid and nucleotide sequences of exemplary anti-PD-1 antibody molecules

|  |  |  |
|---|---|---|
|  |  | GGATATCGCTACCTACTACTGTCAGAACGACTATAGCTACCCCT<br>ACACCTTCGGTCAAGGCACTAAGGTCGAGATTAAG |
| SEQ ID NO: 518 | Light<br>chain | EIVLTQSPATLSLSPGERATLSCKSSQSLLDSGNQKNFLTWYQQKP<br>GKAPKLLIYWASTRESGVPSRFSGSGSGTDFTFTISSLQPEDIATYY<br>CQNDYSYPYTFGQGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 519 | DNA<br>chain<br>light | GAGATCGTCCTGACTCAGTCACCCGCTACCCTGAGCCTGAGCCC<br>TGGCGAGCGGGCTACACTGAGCTGTAAATCTAGTCAGTCACTG<br>CTGGATAGCGGTAATCAGAAGAACTTCCTGACCTGGTATCAGC<br>AGAAGCCCGGTAAAGCCCCTAAGCTGCTGATCTACTGGGCCTC<br>TACTAGAGAATCAGGCGTGCCCTCTAGGTTTAGCGGTAGCGGT<br>AGTGGCACCGACTTCACCTTCACTATCTCTAGCCTGCAGCCCGA<br>GGATATCGCTACCTACTACTGTCAGAACGACTATAGCTACCCCT<br>ACACCTTCGGTCAAGGCACTAAGGTCGAGATTAAGCGTACGGT<br>GGCCGCTCCCAGCGTGTTCATCTTCCCCCCCAGCGACGAGCAGC<br>TGAAGAGCGGCACCGCCAGCGTGGTGTGCCTGCTGAACAACTT<br>CTACCCCCGGGAGGCCAAGGTGCAGTGGAAGGTGGACAACGCC<br>CTGCAGAGCGGCAACAGCCAGGAGAGCGTCACCGAGCAGGAC<br>AGCAAGGACTCCACCTACAGCCTGAGCAGCACCCTGACCCTGA<br>GCAAGGCCGACTACGAGAAGCATAAGGTGTACGCCTGCGAGGT<br>GACCCACCAGGGCCTGTCCAGCCCCGTGACCAAGAGCTTCAAC<br>AGGGGCGAGTGC |

BAP049-Clone-E HC

| SEQ ID NO: 501 (Kabat) | HCDR1 | TYWMH |
| SEQ ID NO: 502 (Kabat) | HCDR2 | NIYPGTGGSNFDEKFKN |
| SEQ ID NO: 503 (Kabat) | HCDR3 | WTTGTGAY |
| SEQ ID NO: 504<br>(Chothia) | HCDR1 | GYTFTTY |
| SEQ ID NO: 505<br>(Chothia) | HCDR2 | YPGTGG |
| SEQ ID NO: 503<br>(Chothia) | HCDR3 | WTTGTGAY |
| SEQ ID NO: 506 | VH | EVQLVQSGAEVKKPGESLRISCKGSGYTFTTYWMHWVRQATGQG<br>LEWMGNIYPGTGGSNFDEKFKNRVTITADKSTSTAYMELSSLRSE<br>DTAVYYCTRWTTGTGAYWGQGTTVTVSS |
| SEQ ID NO: 507 | DNA VH | GAGGTGCAGCTGGTGCAGTCAGGCGCCGAAGTGAAGAAGCCCG<br>GCGAGTCACTGAGAATTAGCTGTAAAGGTTCAGGCTACACCTT<br>CACTACCTACTGGATGCACTGGGTCCGCCAGGCTACCGGTCAA<br>GGCCTCGAGTGGATGGGTAATATCTACCCCGGCACCGGCGGCT<br>CTAACTTCGACGAGAAGTTTAAGAATAGAGTGACTATCACCGC<br>CGATAAGTCTACTAGCACCGCCTATATGGAACTGTCTAGCCTGA<br>GATCAGAGGACACCGCCGTCTACTACTGCACTAGGTGGACTAC<br>CGGCACAGGCGCCTACTGGGGTCAAGGCACTACCGTGACCGTG<br>TCTAGC |
| SEQ ID NO: 508 | Heavy<br>chain | EVQLVQSGAEVKKPGESLRISCKGSGYTFTTYWMHWVRQATGQG<br>LEWMGNIYPGTGGSNFDEKFKNRVTITADKSTSTAYMELSSLRSE<br>DTAVYYCTRWTTGTGAYWGQGTTVTVSSASTKGPSVFPLAPCSRS<br>TSESTAALGCLVKDYFPEPVTVSWNSGALTSGVHTFPAVLQSSGL<br>YSLSSVVTVPSSSLGTKTYTCNVDHKPSNTKVDKRVESKYGPPCPP<br>CPAPEFLGGPSVFLFPPKPKDTLMISRTPEVTCVVVDVSQEDPEVQF<br>NWYVDGVEVHNAKTKPREEQFNSTYRVVSVLTVLHQDWLNGKE<br>YKCKVSNKGLPSSIEKTISKAKGQPREPQVYTLPPSQEEMTKNQVS<br>LTCLVKGFYPSDIAVEWESNGQPENNYKTTPPVLDSDGSFFLYSRL<br>TVDKSRWQEGNVFSCSVMHEALHNHYTQKSLSLSLG |
| SEQ ID NO: 509 | DNA<br>heavy<br>chain | GAGGTGCAGCTGGTGCAGTCAGGCGCCGAAGTGAAGAAGCCCG<br>GCGAGTCACTGAGAATTAGCTGTAAAGGTTCAGGCTACACCTT<br>CACTACCTACTGGATGCACTGGGTCCGCCAGGCTACCGGTCAA<br>GGCCTCGAGTGGATGGGTAATATCTACCCCGGCACCGGCGGCT<br>CTAACTTCGACGAGAAGTTTAAGAATAGAGTGACTATCACCGC<br>CGATAAGTCTACTAGCACCGCCTATATGGAACTGTCTAGCCTGA<br>GATCAGAGGACACCGCCGTCTACTACTGCACTAGGTGGACTAC<br>CGGCACAGGCGCCTACTGGGGTCAAGGCACTACCGTGACCGTG<br>TCTAGCGCTAGCACTAAGGGCCCGTCCGTGTTCCCCCTGGCACC |

TABLE 3-continued

Amino acid and nucleotide sequences of exemplary anti-PD-1 antibody molecules

|  |  |  |
|---|---|---|
|  |  | TTGTAGCCGGAGCACTAGCGAATCCACCGCTGCCCTCGGCTGCC<br>TGGTCAAGGATTACTTCCCGGAGCCCGTGACCGTGTCCTGGAAC<br>AGCGGAGCCCTGACCTCCGGAGTGCACACCTTCCCCGCTGTGCT<br>GCAGAGCTCCGGGCTGTACTCGCTGTCGTCGGTGGTCACGGTGC<br>CTTCCATCTAGCCTGGGTACCAAGACCTACACTTGCAACGTGGAC<br>CACAAGCCTTCCAACACTAAGGTGGACAAGCGCGTCGAATCGA<br>AGTACGGCCCACCGTGCCCGCCTTGTCCCGCGCCGGAGTTCCTC<br>GGCGGTCCCTCGGTCTTTCTGTTCCCACCGAAGCCCAAGGACAC<br>TTTGATGATTTCCCGCACCCCTGAAGTGACATGCGTGGTCGTGG<br>ACGTGTCACAGGAAGATCCGGAGGTGCAGTTCAATTGGTACGT<br>GGATGGCGTCGAGGTGCACAACGCCAAAACCAAGCCGAGGGA<br>GGAGCAGTTCAACTCCACTTACCGCGTCGTGTCCGTGCTGACGG<br>TGCTGCATCAGGACTGGCTGAACGGGAAGGAGTACAAGTGCAA<br>AGTGTCCAACAAGGGACTTCCTAGCTCAATCGAAAAGACCATC<br>TCGAAAGCCAAGGGACAGCCCCGGGAACCCCAAGTGTATACCC<br>TGCCACCGAGCCAGGAAGAAATGACTAAGAACCAAGTCTCATT<br>GACTTGCCTTGTGAAGGGCTTCTACCCATCGGATATCGCCGTGG<br>AATGGGAGTCCAACGGCCAGCCGGAAAACAACTACAAGACCA<br>CCCCTCCGGTGCTGGACTCAGACGGATCCTTCTTCCTCTACTCG<br>CGGCTGACCGTGGATAAGAGCAGATGGCAGGAGGGAAATGTGT<br>TCAGCTGTTCTGTGATGCATGAAGCCCTGCACAACCACTACACT<br>CAGAAGTCCCTGTCCCTCTCCCTGGGA |
| BAP049-Clone-E LC |  |  |
| SEQ ID NO: 510 (Kabat) | LCDR1 | KSSQSLLDSGNQKNFLT |
| SEQ ID NO: 511 (Kabat) | LCDR2 | WASTRES |
| SEQ ID NO: 512 (Kabat) | LCDR3 | QNDYSYPYT |
| SEQ ID NO: 513 (Chothia) | LCDR1 | SQSLLDSGNQKNF |
| SEQ ID NO: 514 (Chothia) | LCDR2 | WAS |
| SEQ ID NO: 515 (Chothia) | LCDR3 | DYSYPY |
| SEQ ID NO: 520 | VL | EIVLTQSPATLSLSPGERATLSCKSSQSLLDSGNQKNFLTWYQQKP<br>GQAPRLLIYWASTRESGVPSRFSGSGSGTDFTFTISSLEAEDAATYY<br>CQNDYSYPYTFGQGTKVEIK |
| SEQ ID NO: 521 | DNA VL | GAGATCGTCCTGACTCAGTCACCCGCTACCCTGAGCCTGAGCCC<br>TGGCGAGCGGGCTACACTGAGCTGTAAATCTAGTCAGTCACTG<br>CTGGATAGCGGTAATCAGAAGAACTTCCTGACCTGGTATCAGC<br>AGAAGCCCGGTCAAGCCCCTAGACTGCTGATCTACTGGGCCTCT<br>ACTAGAGAATCAGGCGTGCCCTCTAGGTTTAGCGGTAGCGGTA<br>GTGGCACCGACTTCACCTTCACTATCTCTAGCCTGGAAGCCGAG<br>GACGCCGCTACCTACTACTGTCAGAACGACTATAGCTACCCCTA<br>CACCTTCGGTCAAGGCACTAAGGTCGAGATTAAG |
| SEQ ID NO: 522 | Light chain | EIVLTQSPATLSLSPGERATLSCKSSQSLLDSGNQKNFLTWYQQKP<br>GQAPRLLIYWASTRESGVPSRFSGSGSGTDFTFTISSLEAEDAATYY<br>CQNDYSYPYTFGQGTKVEIKRTVAAPSVFIFPPSDEQLKSGTASVV<br>CLLNNFYPREAKVQWKVDNALQSGNSQESVTEQDSKDSTYSLSST<br>LTLSKADYEKHKVYACEVTHQGLSSPVTKSFNRGEC |
| SEQ ID NO: 523 | DNA light chain | GAGATCGTCCTGACTCAGTCACCCGCTACCCTGAGCCTGAGCCC<br>TGGCGAGCGGGCTACACTGAGCTGTAAATCTAGTCAGTCACTG<br>CTGGATAGCGGTAATCAGAAGAACTTCCTGACCTGGTATCAGC<br>AGAAGCCCGGTCAAGCCCCTAGACTGCTGATCTACTGGGCCTCT<br>ACTAGAGAATCAGGCGTGCCCTCTAGGTTTAGCGGTAGCGGTA<br>GTGGCACCGACTTCACCTTCACTATCTCTAGCCTGGAAGCCGAG<br>GACGCCGCTACCTACTACTGTCAGAACGACTATAGCTACCCCTA<br>CACCTTCGGTCAAGGCACTAAGGTCGAGATTAAGCGTACGGTG<br>GCCGCTCCCAGCGTGTTCATCTTCCCCCCCAGCGACGAGCAGCT<br>GAAGAGCGGCACCGCCAGCGTGGTGTGCCTGCTGAACAACTTC<br>TACCCCCGGGAGGCCAAGGTGCAGTGGAAGGTGGACAACGCCC<br>TGCAGAGCGGCAACAGCCAGGAGAGCGTCACCGAGCAGGACA<br>GCAAGGACTCCACCTACAGCCTGAGCAGCACCCTGACCCTGAG<br>CAAGGCCGACTACGAGAAGCATAAGGTGTACGCCTGCGAGGTG<br>ACCCACCAGGGCCTGTCCAGCCCCGTGACCAAGAGCTTCAACA<br>GGGGCGAGTGC |

TABLE 3-continued

Amino acid and nucleotide sequences of exemplary anti-PD-1 antibody molecules

BAP049-Clone-B HC

| | | |
|---|---|---|
| SEQ ID NO: 524 (Kabat) | HCDR1 | ACCTACTGGATGCAC |
| SEQ ID NO: 525 (Kabat) | HCDR2 | AATATCTACCCCGGCACCGGCGGCTCTAACTTCGACGAGAAGT TTAAGAAT |
| SEQ ID NO: 526 (Kabat) | HCDR3 | TGGACTACCGGCACAGGCGCCTAC |
| SEQ ID NO: 527 (Chothia) | HCDR1 | GGCTACACCTTCACTACCTAC |
| SEQ ID NO: 528 (Chothia) | HCDR2 | TACCCCGGCACCGGCGGC |
| SEQ ID NO: 526 (Chothia) | HCDR3 | TGGACTACCGGCACAGGCGCCTAC |

BAP049-Clone-B LC

| | | |
|---|---|---|
| SEQ ID NO: 529 (Kabat) | LCDR1 | AAATCTAGTCAGTCACTGCTGGATAGCGGTAATCAGAAGAACT TCCTGACC |
| SEQ ID NO: 530 (Kabat) | LCDR2 | TGGGCCTCTACTAGAGAATCA |
| SEQ ID NO: 531 (Kabat) | LCDR3 | CAGAACGACTATAGCTACCCCTACACC |
| SEQ ID NO: 532 (Chothia) | LCDR1 | AGTCAGTCACTGCTGGATAGCGGTAATCAGAAGAACTTC |
| SEQ ID NO: 533 (Chothia) | LCDR2 | TGGGCCTCT |
| SEQ ID NO: 534 (Chothia) | LCDR3 | GACTATAGCTACCCCTAC |

BAP049-Clone-E HC

| | | |
|---|---|---|
| SEQ ID NO: 524 (Kabat) | HCDR1 | ACCTACTGGATGCAC |
| SEQ ID NO: 525 (Kabat) | HCDR2 | AATATCTACCCCGGCACCGGCGGCTCTAACTTCGACGAGAAGT TTAAGAAT |
| SEQ ID NO: 526 (Kabat) | HCDR3 | TGGACTACCGGCACAGGCGCCTAC |
| SEQ ID NO: 527 (Chothia) | HCDR1 | GGCTACACCTTCACTACCTAC |
| SEQ ID NO: 528 (Chothia) | HCDR2 | TACCCCGGCACCGGCGGC |
| SEQ ID NO: 526 (Chothia) | HCDR3 | TGGACTACCGGCACAGGCGCCTAC |

BAP049-Clone-E LC

| | | |
|---|---|---|
| SEQ ID NO: 529 (Kabat) | LCDR1 | AAATCTAGTCAGTCACTGCTGGATAGCGGTAATCAGAAGAACT TCCTGACC |
| SEQ ID NO: 530 (Kabat) | LCDR2 | TGGGCCTCTACTAGAGAATCA |
| SEQ ID NO: 531 (Kabat) | LCDR3 | CAGAACGACTATAGCTACCCCTACACC |
| SEQ ID NO: 532 (Chothia) | LCDR1 | AGTCAGTCACTGCTGGATAGCGGTAATCAGAAGAACTTC |
| SEQ ID NO: 533 (Chothia) | LCDR2 | TGGGCCTCT |
| SEQ ID NO: 534 (Chothia) | LCDR3 | GACTATAGCTACCCCTAC |

Other Exemplary PD-1 Inhibitors

In one embodiment, the anti-PD-1 antibody molecule is Nivolumab (Bristol-Myers Squibb), also known as MDX-1106, MDX-1106-04, ONO-4538, BMS-936558, or OPDIVO®. Nivolumab (clone 5C4) and other anti-PD-1 antibodies are disclosed in U.S. Pat. No. 8,008,449 and WO 2006/121168, incorporated by reference in their entirety. In one embodiment, the anti-PD-1 antibody molecule comprises one or more of the CDR sequences (or collectively all of the CDR sequences), the heavy chain or light chain variable region sequence, or the heavy chain or light chain sequence of Nivolumab, e.g., as disclosed in Table 4.

In one embodiment, the anti-PD-1 antibody molecule is Pembrolizumab (Merck & Co), also known as Lambrolizumab, MK-3475, MK03475, SCH-900475, or KEYTRUDA®. Pembrolizumab and other anti-PD-1 antibodies are disclosed in Hamid, O. et al. (2013) *New England Journal of Medicine* 369 (2): 134-44, U.S. Pat. No. 8,354,509, and WO 2009/114335, incorporated by reference in their entirety. In one embodiment, the anti-PD-1 antibody molecule comprises one or more of the CDR sequences (or collectively all of the CDR sequences), the heavy chain or light chain variable region sequence, or the heavy chain or light chain sequence of Pembrolizumab, e.g., as disclosed in Table 4.

In one embodiment, the anti-PD-1 antibody molecule is Pidilizumab (CureTech), also known as CT-011. Pidilizumab and other anti-PD-1 antibodies are disclosed in Rosenblatt, J. et al. (2011) *J Immunotherapy* 34(5): 409-18, U.S. Pat. Nos. 7,695,715, 7,332,582, and 8,686,119, incorporated by reference in their entirety. In one embodiment, the anti-PD-1 antibody molecule comprises one or more of the CDR sequences (or collectively all of the CDR sequences), the heavy chain or light chain variable region sequence, or the heavy chain or light chain sequence of Pidilizumab, e.g., as disclosed in Table 4.

In one embodiment, the anti-PD-1 antibody molecule is MEDI0680 (Medimmune), also known as AMP-514. MEDI0680 and other anti-PD-1 antibodies are disclosed in U.S. Pat. No. 9,205,148 and WO 2012/145493, incorporated by reference in their entirety. In one embodiment, the anti-PD-1 antibody molecule comprises one or more of the CDR sequences (or collectively all of the CDR sequences), the heavy chain or light chain variable region sequence, or the heavy chain or light chain sequence of MEDI0680.

In one embodiment, the anti-PD-1 antibody molecule is REGN2810 (Regeneron). In one embodiment, the anti-PD-1 antibody molecule comprises one or more of the CDR sequences (or collectively all of the CDR sequences), the heavy chain or light chain variable region sequence, or the heavy chain or light chain sequence of REGN2810.

In one embodiment, the anti-PD-1 antibody molecule is PF-06801591 (Pfizer). In one embodiment, the anti-PD-1 antibody molecule comprises one or more of the CDR sequences (or collectively all of the CDR sequences), the heavy chain or light chain variable region sequence, or the heavy chain or light chain sequence of PF-06801591.

In one embodiment, the anti-PD-1 antibody molecule is BGB-A317 or BGB-108 (Beigene). In one embodiment, the anti-PD-1 antibody molecule comprises one or more of the CDR sequences (or collectively all of the CDR sequences), the heavy chain or light chain variable region sequence, or the heavy chain or light chain sequence of BGB-A317 or BGB-108.

In one embodiment, the anti-PD-1 antibody molecule is INCSHR1210 (Incyte), also known as INCSHR01210 or SHR-1210. In one embodiment, the anti-PD-1 antibody molecule comprises one or more of the CDR sequences (or collectively all of the CDR sequences), the heavy chain or light chain variable region sequence, or the heavy chain or light chain sequence of INCSHR1210.

In one embodiment, the anti-PD-1 antibody molecule is TSR-042 (Tesaro), also known as ANB011. In one embodiment, the anti-PD-1 antibody molecule comprises one or more of the CDR sequences (or collectively all of the CDR sequences), the heavy chain or light chain variable region sequence, or the heavy chain or light chain sequence of TSR-042.

Further known anti-PD-1 antibodies include those described, e.g., in WO 2015/112800, WO 2016/092419, WO 2015/085847, WO 2014/179664, WO 2014/194302, WO 2014/209804, WO 2015/200119, U.S. Pat. Nos. 8,735,553, 7,488,802, 8,927,697, 8,993,731, and 9,102,727, incorporated by reference in their entirety.

In one embodiment, the anti-PD-1 antibody is an antibody that competes for binding with, and/or binds to the same epitope on PD-1 as, one of the anti-PD-1 antibodies described herein.

In one embodiment, the PD-1 inhibitor is a peptide that inhibits the PD-1 signaling pathway, e.g., as described in U.S. Pat. No. 8,907,053, incorporated by reference in its entirety. In one embodiment, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In one embodiment, the PD-1 inhibitor is AMP-224 (B7-DCIg (Amplimmune), e.g., disclosed in WO 2010/027827 and WO 2011/066342, incorporated by reference in their entirety).

TABLE 4

Amino acid sequences of other exemplary anti-PD-1 antibody molecules

Nivolumab

| | | |
|---|---|---|
| SEQ ID NO: 535 | Heavy chain | QVQLVESGGGVVQPGRSLRLDCKASGITFSNSGMHWVRQAPGKGLEWVAV IWYDGSKRYYADSVKGRFTISRDNSKNTLFLQMNSLRAEDTAVYYCATND DYWGQGTLVTVSSASTKGPSVFPLAPCSRSTSESTAALGCLVKDYFPEPVTV SWNSGALTSGVHTFPAVLQSSGLYSLSSVVTVPSSSLGTKTYTCNVDHKPSN TKVDKRVESKYGPPCPPCPAPEFLGGPSVFLFPPKPKDTLMISRTPEVTCVVV DVSQEDPEVQFNWYVDGVEVHNAKTKPREEQFNSTYRVVSVLTVLHQDW LNGKEYKCKVSNKGLPSSIEKTISKAKGQPREPQVYTLPPSQEEMTKNQVSL TCLVKGFYPSDIAVEWESNGQPENNYKTTPPVLDSDGSFFLYSRLTVDKSR WQEGNVFSCSVMHEALHNHYTQKSLSLSLGK |
| SEQ ID NO: 536 | Light chain | EIVLTQSPATLSLSPGERATLSCRASQSVSSYLAWYQQKPGQAPRLLIYDASN RATGIPARFSGSGSGTDFTLTISSLEPEDFAVYYCQQSSNWPRTFGQGTKVEI KRTVAAPSVFIFPPSDEQLKSGTASVVCLLNNFYPREAKVQWKVDNALQSG |

TABLE 4-continued

Amino acid sequences of other exemplary anti-PD-1 antibody molecules

```
                NSQESVTEQDSKDSTYSLSSTLTLSKADYEKHKVYACEVTHQGLSSPVTKSF
                NRGEC
```

Pembrolizumab

```
SEQ ID NO: 537  Heavy   QVQLVQSGVEVKKPGASVKVSCKASGYTFTNYYMYWVRQAPGQGLEWM
                chain   GGINPSNGGTNFNEKFKNRVTLTTDSSTTTAYMELKSLQFDDTAVYYCARR
                        DYRFDMGFDYWGQGTTVTVSSASTKGPSVFPLAPCSRSTSESTAALGCLVK
                        DYFPEPVTVSWNSGALTSGVHTFPAVLQSSGLYSLSSVVTVPSSSLGTKTYT
                        CNVDHKPSNTKVDKRVESKYGPPCPPCPAPEFLGGPSVFLFPPKPKDTLMISR
                        TPEVTCVVVDVSQEDPEVQFNWYVDGVEVHNAKTKPREEQFNSTYRVVSV
                        LTVLHQDWLNGKEYKCKVSNKGLPSSIEKTISKAKGQPREPQVYTLPPSQEE
                        MTKNQVSLTCLVKGFYPSDIAVEWESNGQPENNYKTTPPVLDSDGSFFLYS
                        RLTVDKSRWQEGNVFSCSVMHEALHNHYTQKSLSLSLGK SEQ ID NO: 538  Light   EIVLTQSPATLSLSPGERATLSCRASKGVSTSGYSYLHWYQQKPGQAPRLLI
                chain   YLASYLESGVPARFSGSGSGTDFTLTISSLEPEDFAVYYCQHSRDLPLTFGGG
                        TKVEIKRTVAAPSVFIFPPSDEQLKSGTASVVCLLNNFYPREAKVQWKVDNA
                        LQSGNSQESVTEQDSKDSTYSLSSTLTLSKADYEKHKVYACEVTHQGLSSPV
                        TKSFNRGEC
```

Pidilizumab

```
SEQ ID NO: 539  Heavy   QVQLVQSGSELKKPGASVKISCKASGYTFTNYGMNWVRQAPGQGLQWMG
                chain   WINTDSGESTYAEEFKGRFVFSLDTSVNTAYLQITSLTAEDTGMYFCVRVGY
                        DALDYWGQGTLVTVSSASTKGPSVFPLAPSSKSTSGGTAALGCLVKDYFPEP
                        VTVSWNSGALTSGVHTFPAVLQSSGLYSLSSVVTVPSSSLGTQTYICNVNHK
                        PSNTKVDKRVEPKSCDKTHTCPPCPAPELLGGPSVFLFPPKPKDTLMISRTPE
                        VTCVVVDVSHEDPEVKFNWYVDGVEVHNAKTKPREEQYNSTYRVVSVLT
                        VLHQDWLNGKEYKCKVSNKALPAPIEKTISKAKGQPREPQVYTLPPSREEM
                        TKNQVSLTCLVKGFYPSDIAVEWESNGQPENNYKTTPPVLDSDGSFFLYSKL
                        TVDKSRWQQGNVFSCSVMHEALHNHYTQKSLSLSPGK SEQ ID NO: 540  Light   EIVLTQSPSSLSASVGDRVTITCSARSSVSYMHWFQQKPGKAPKLWIYRTSN
                chain   LASGVPSRFSGSGSGTSYCLTINSLQPEDFATYYCQQRSSFPLTFGGGTKLEIK
                        RTVAAPSVFIFPPSDEQLKSGTASVVCLLNNFYPREAKVQWKVDNALQSGN
                        SQESVTEQDSKDSTYSLSSTLTLSKADYEKHKVYACEVTHQGLSSPVTKSFN
                        RGEC
```

In one embodiment the anti-human ENTPD2 antibody as described herein is administered in combination with at least one PD1 inhibitor as described herein and at least one A2A receptor antagonist as described herein.

PD-L1 Inhibitors

In certain embodiments, the anti-human ENTPD2 antibody as described herein is administered in combination with a PD-L1 inhibitor. The PD-L1 inhibitor may be an antibody, an antigenbinding fragment thereof, an immunoadhesin, a fusion protein, or an oligopeptide. In some embodiments, the PD-L1 inhibitor is chosen from FAZ053 (Novartis), Atezolizumab, also known as Tecentriq® (Genentech/Roche), Avelumab, also known as Bavencio® (Merck Serono and Pfizer), Durvalumab, also known as Imfinzi® (MedImmune/AstraZeneca), or BMS-936559 (Bristol-Myers Squibb).

Exemplary PD-L1 Inhibitors

In one embodiment, the PD-L1 inhibitor is an anti-PD-L1 antibody molecule. In one embodiment, the PD-L1 inhibitor is an anti-PD-L1 antibody molecule as disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule comprises at least one, two, three, four, five or six complementarity determining regions (CDRs) (or collectively all of the CDRs) from a heavy and light chain variable region comprising an amino acid sequence shown in Table 5 (e.g., from the heavy and light chain variable region sequences of BAP058-Clone O or BAP058-Clone N disclosed in Table 5), or encoded by a nucleotide sequence shown in Table 5. In some embodiments, the CDRs are according to the Kabat definition (e.g., as set out in Table 5). In some embodiments, the CDRs are according to the Chothia definition (e.g., as set out in Table 5). In some embodiments, the CDRs are according to the combined CDR definitions of both Kabat and Chothia (e.g., as set out in Table 5). In one embodiment, the combination of Kabat and Chothia CDR of VH CDR1 comprises the amino acid sequence GYTFTSYWMY (SEQ ID NO: 647). In one embodiment, one or more of the CDRs (or collectively all of the CDRs) have one, two, three, four, five, six or more changes, e.g., amino acid substitutions (e.g., conservative amino acid substitutions) or deletions, relative to an amino acid sequence shown in Table 5, or encoded by a nucleotide sequence shown in Table 5.

In one embodiment, the anti-PD-L1 antibody molecule comprises a heavy chain variable region (VH) comprising a VHCDR1 amino acid sequence of SEQ ID NO: 601, a VHCDR2 amino acid sequence of SEQ ID NO: 602, and a VHCDR3 amino acid sequence of SEQ ID NO: 603; and a light chain variable region (VL) comprising a VLCDR1 amino acid sequence of SEQ ID NO: 609, a VLCDR2 amino acid sequence of SEQ ID NO: 610, and a VLCDR3 amino acid sequence of SEQ ID NO: 611, each disclosed in Table 5.

In one embodiment, the anti-PD-L1 antibody molecule comprises a VH comprising a VHCDR1 encoded by the nucleotide sequence of SEQ ID NO: 628, a VHCDR2 encoded by the nucleotide sequence of SEQ ID NO: 629, and a VHCDR3 encoded by the nucleotide sequence of SEQ ID NO: 630; and a VL comprising a VLCDR1 encoded by the nucleotide sequence of SEQ ID NO: 633, a VLCDR2 encoded by the nucleotide sequence of SEQ ID NO: 634, and a VLCDR3 encoded by the nucleotide sequence of SEQ ID NO: 635, each disclosed in Table 5.

In one embodiment, the anti-PD-L1 antibody molecule comprises a VH comprising the amino acid sequence of SEQ ID NO: 606, or an amino acid sequence at least 85%, 90%, 95%, or 99% identical or higher to SEQ ID NO: 606. In one embodiment, the anti-PD-L1 antibody molecule comprises a VL comprising the amino acid sequence of SEQ ID NO: 616, or an amino acid sequence at least 85%, 90%, 95%, or 99% identical or higher to SEQ ID NO: 616. In one embodiment, the anti-PD-L1 antibody molecule comprises a VH comprising the amino acid sequence of SEQ ID NO: 620, or an amino acid sequence at least 85%, 90%, 95%, or 99% identical or higher to SEQ ID NO: 620. In one embodiment, the anti-PD-L1 antibody molecule comprises a VL comprising the amino acid sequence of SEQ ID NO: 624, or an amino acid sequence at least 85%, 90%, 95%, or 99% identical or higher to SEQ ID NO: 624. In one embodiment, the anti-PD-L1 antibody molecule comprises a VH comprising the amino acid sequence of SEQ ID NO: 606 and a VL comprising the amino acid sequence of SEQ ID NO: 616. In one embodiment, the anti-PD-L1 antibody molecule comprises a VH comprising the amino acid sequence of SEQ ID NO: 620 and a VL comprising the amino acid sequence of SEQ ID NO: 624.

In one embodiment, the antibody molecule comprises a VH encoded by the nucleotide sequence of SEQ ID NO: 607, or a nucleotide sequence at least 85%, 90%, 95%, or 99% identical or higher to SEQ ID NO: 607. In one embodiment, the antibody molecule comprises a VL encoded by the nucleotide sequence of SEQ ID NO: 617, or a nucleotide sequence at least 85%, 90%, 95%, or 99% identical or higher to SEQ ID NO: 617. In one embodiment, the antibody molecule comprises a VH encoded by the nucleotide sequence of SEQ ID NO: 621, or a nucleotide sequence at least 85%, 90%, 95%, or 99% identical or higher to SEQ ID NO: 621. In one embodiment, the antibody molecule comprises a VL encoded by the nucleotide sequence of SEQ ID NO: 625, or a nucleotide sequence at least 85%, 90%, 95%, or 99% identical or higher to SEQ ID NO: 625. In one embodiment, the antibody molecule comprises a VH encoded by the nucleotide sequence of SEQ ID NO: 607 and a VL encoded by the nucleotide sequence of SEQ ID NO: 617. In one embodiment, the antibody molecule comprises a VH encoded by the nucleotide sequence of SEQ ID NO: 621 and a VL encoded by the nucleotide sequence of SEQ ID NO: 625.

In one embodiment, the anti-PD-L1 antibody molecule comprises a heavy chain comprising the amino acid sequence of SEQ ID NO: 608, or an amino acid sequence at least 85%, 90%, 95%, or 99% identical or higher to SEQ ID NO: 608. In one embodiment, the anti-PD-L1 antibody molecule comprises a light chain comprising the amino acid sequence of SEQ ID NO: 618, or an amino acid sequence at least 85%, 90%, 95%, or 99% identical or higher to SEQ ID NO: 618. In one embodiment, the anti-PD-L1 antibody molecule comprises a heavy chain comprising the amino acid sequence of SEQ ID NO: 622, or an amino acid sequence at least 85%, 90%, 95%, or 99% identical or higher to SEQ ID NO: 622. In one embodiment, the anti-PD-L1 antibody molecule comprises a light chain comprising the amino acid sequence of SEQ ID NO: 626, or an amino acid sequence at least 85%, 90%, 95%, or 99% identical or higher to SEQ ID NO: 626. In one embodiment, the anti-PD-L1 antibody molecule comprises a heavy chain comprising the amino acid sequence of SEQ ID NO: 608 and a light chain comprising the amino acid sequence of SEQ ID NO: 618. In one embodiment, the anti-PD-L1 antibody molecule comprises a heavy chain comprising the amino acid sequence of SEQ ID NO: 622 and a light chain comprising the amino acid sequence of SEQ ID NO: 626.

In one embodiment, the antibody molecule comprises a heavy chain encoded by the nucleotide sequence of SEQ ID NO: 615, or a nucleotide sequence at least 85%, 90%, 95%, or 99% identical or higher to SEQ ID NO: 615. In one embodiment, the antibody molecule comprises a light chain encoded by the nucleotide sequence of SEQ ID NO: 619, or a nucleotide sequence at least 85%, 90%, 95%, or 99% identical or higher to SEQ ID NO: 619. In one embodiment, the antibody molecule comprises a heavy chain encoded by the nucleotide sequence of SEQ ID NO: 623, or a nucleotide sequence at least 85%, 90%, 95%, or 99% identical or higher to SEQ ID NO: 623. In one embodiment, the antibody molecule comprises a light chain encoded by the nucleotide sequence of SEQ ID NO: 627, or a nucleotide sequence at least 85%, 90%, 95%, or 99% identical or higher to SEQ ID NO: 627. In one embodiment, the antibody molecule comprises a heavy chain encoded by the nucleotide sequence of SEQ ID NO: 615 and a light chain encoded by the nucleotide sequence of SEQ ID NO: 619. In one embodiment, the antibody molecule comprises a heavy chain encoded by the nucleotide sequence of SEQ ID NO: 623 and a light chain encoded by the nucleotide sequence of SEQ ID NO: 627.

The antibody molecules described herein can be made by vectors, host cells, and methods described in US 2016/0108123, incorporated by reference in its entirety.

TABLE 5

Amino acid and nucleotide sequences of exemplary anti-PD-L1 antibody molecules

BAP058-Clone O HC

| SEQ ID NO: 601 (Kabat) | HCDR1 | SYWMY |
|---|---|---|
| SEQ ID NO: 602 (Kabat) | HCDR2 | RIDPNSGSTKYNEKFKN |
| SEQ ID NO: 603 (Kabat) | HCDR3 | DYRKGLYAMDY |
| SEQ ID NO: 604 (Chothia) | HCDR1 | GYTFTSY |
| SEQ ID NO: 605 (Chothia) | HCDR2 | DPNSGS |

TABLE 5-continued

Amino acid and nucleotide sequences of exemplary anti-PD-L1 antibody molecules

| | | |
|---|---|---|
| SEQ ID NO: 603 (Chothia) | HCDR3 | DYRKGLYAMDY |
| SEQ ID NO: 606 | VH | EVQLVQSGAEVKKPGATVKISCKVSGYTFTSYWMYWVRQARGQ RLEWIGRIDPNSGSTKYNEKFKNRFTISRDNSKNTLYLQMNSLRA EDTAVYYCARDYRKGLYAMDYWGQGTTVTVSS |
| SEQ ID NO: 607 | DNA VH | GAAGTGCAGCTGGTGCAGTCAGGCGCCGAAGTGAAGAAACCC GGCGCTACCGTGAAGATTAGCTGTAAAGTCTCAGGCTACACCT TCACTAGCTACTGGATGTACTGGGTCCGACAGGCTAGAGGGCA AAGACTGGAGTGGATCGGTAGAATCGACCCTAATAGCGGCTC TACTAAGTATAACGAGAAGTTTAAGAATAGGTTCACTATTAGT AGGGATAACTCTAAGAACACCCTGTACCTGCAGATGAATAGC CTGAGAGCCGAGGACACCGCCGTCTACTACTGCGCTAGAGACT ATAGAAAGGGCCTGTACGCTATGGACTACTGGGGTCAAGGCA CTACCGTGACCGTGTCTTCA |
| SEQ ID NO: 608 | Heavy chain | EVQLVQSGAEVKKPGATVKISCKVSGYTFTSYWMYWVRQARGQ RLEWIGRIDPNSGSTKYNEKFKNRFTISRDNSKNTLYLQMNSLRA EDTAVYYCARDYRKGLYAMDYWGQGTTVTVSSASTKGPSVFPL APCSRSTSESTAALGCLVKDYFPEPVTVSWNSGALTSGVHTFPAV LQSSGLYSLSSVVTVPSSSLGTKTYTCNVDHKPSNTKVDKRVESK YGPPCPPCPAPEFLGGPSVFLFPPKPKDTLMISRTPEVTCVVVDVS QEDPEVQFNWYVDGVEVHNAKTKPREEQFNSTYRVVSVLTVLH QDWLNGKEYKCKVSNKGLPSSIEKTISKAKGQPREPQVYTLPPSQ EEMTKNQVSLTCLVKGFYPSDIAVEWESNGQPENNYKTTPPVLD SDGSFFLYSRLTVDKSRWQEGNVFSCSVMHEALHNHYTQKSLSL SLG |
| SEQ ID NO: 615 | DNA heavy chain | GAAGTGCAGCTGGTGCAGTCAGGCGCCGAAGTGAAGAAACCC GGCGCTACCGTGAAGATTAGCTGTAAAGTCTCAGGCTACACCT TCACTAGCTACTGGATGTACTGGGTCCGACAGGCTAGAGGGCA AAGACTGGAGTGGATCGGTAGAATCGACCCTAATAGCGGCTC TACTAAGTATAACGAGAAGTTTAAGAATAGGTTCACTATTAGT AGGGATAACTCTAAGAACACCCTGTACCTGCAGATGAATAGC CTGAGAGCCGAGGACACCGCCGTCTACTACTGCGCTAGAGACT ATAGAAAGGGCCTGTACGCTATGGACTACTGGGGTCAAGGCA CTACCGTGACCGTGTCTTCAGCTAGCACTAAGGGCCCGTCCGT GTTCCCCCTGGCACCTTGTAGCCGGAGCACTAGCGAATCCACC GCTGCCCTCGGCTGCCTGGTCAAGGATTACTTCCCGGAGCCCG TGACCGTGTCCTGGAACAGCGGAGCCCTGACCTCCGGAGTGCA CACCTTCCCGCTGTGCTGCAGAGCTCCGGGCTGTACTGCTG TCGTCGGTGGTCACGGTGCCTTCATCTAGCCTGGGTACCAAGA CCTACACTTGCAACGTGGACCACAAGCCTTCCAACACTAAGGT GGACAAGCGCGTCGAATCGAAGTACGGCCCACCGTGCCCGCC TTGTCCCGCGCCGGAGTTCCTCGGCGGTCCCTCGGTCTTTCTGT TCCCACCGAAGCCCAAGGACACTTTGATGATTTCCCGCACCCC TGAAGTGACATGCGTGGTCGTGGACGTGTCACAGGAAGATCC GGAGGTGCAGTTCAATTGGTACGTGGATGGCGTCGAGGTGCA CAACGCCAAAACCAAGCCGAGGGAGGAGCAGTTCAACTCCAC TTACCGCGTCGTGTCCGTGCTGACGGTGCTGCATCAGGACTGG CTGAACGGGAAGGAGTACAAGTGCAAAGTGTCCAACAAGGGA CTTCCTAGCTCAATCGAAAAGACCATCTCGAAAGCCAAGGGA CAGCCCCGGGAACCCCAAGTGTATACCCTGCCACCGAGCCAG GAAGAAATGACTAAGAACCAAGTCTCATTGACTTGCCTTGTGA AGGGCTTCTACCCATCGGATATCGCCGTGGAATGGGAGTCCAA CGGCCAGCCGGAAAACAACTACAAGACCACCCCTCCGGTGCT GGACTCAGACGGATCCTTCTTCCTCTACTCGCGGCTGACCGTG GATAAGAGCAGATGGCAGGAGGGAAATGTGTTCAGCTGTTCT GTGATGCATGAAGCCCTGCACAACCACTACACTCAGAAGTCCC TGTCCCTCTCCCTGGGA |

BAP058-Clone O LC

| | | |
|---|---|---|
| SEQ ID NO: 609 (Kabat) | LCDR1 | KASQDVGTAVA |
| SEQ ID NO: 610 (Kabat) | LCDR2 | WASTRHT |
| SEQ ID NO: 611 (Kabat) | LCDR3 | QQYNSYPLT |
| SEQ ID NO: 612 (Chothia) | LCDR1 | SQDVGTA |
| SEQ ID NO: 613 (Chothia) | LCDR2 | WAS |

TABLE 5-continued

Amino acid and nucleotide sequences of exemplary anti-PD-L1 antibody molecules

| | | |
|---|---|---|
| SEQ ID NO: 614 (Chothia) | LCDR3 | YNSYPL |
| SEQ ID NO: 616 | VL | AIQLTQSPSSLSASVGDRVTITCKASQDVGTAVAWYLQKPGQSPQ LLIYWASTRHTGVPSRFSGSGSGTDFTFTISSLEAEDAATYYCQQY NSYPLTFGQGTKVEIK |
| SEQ ID NO: 617 | DNA VL | GCTATTCAGCTGACTCAGTCACCTAGTAGCCTGAGCGCTAGTG TGGGCGATAGAGTGACTATCACCTGTAAAGCCTCTCAGGACGT GGGCACCGCCGTGGCCTGGTATCTGCAGAAGCCTGGTCAATCA CCTCAGCTGCTGATCTACTGGGCCTCTACTAGACACACCGGCG TGCCCTCTAGGTTTAGCGGTAGCGGTAGTGGCACCGACTTCAC CTTCACTATCTCTTCACTGGAAGCCGAGGACGCCGCTACCTAC TACTGTCAGCAGTATAATAGCTACCCCCTGACCTTCGGTCAAG GCACTAAGGTCGAGATTAAG |
| SEQ ID NO: 618 | Light chain | AIQLTQSPSSLSASVGDRVTITCKASQDVGTAVAWYLQKPGQSPQ LLIYWASTRHTGVPSRFSGSGSGTDFTFTISSLEAEDAATYYCQQY NSYPLTFGQGTKVEIKRTVAAPSVFIFPPSDEQLKSGTASVVCLLN NFYPREAKVQWKVDNALQSGNSQESVTEQDSKDSTYSLSSTLTL SKADYEKHKVYACEVTHQGLSSPVTKSFNRGEC |
| SEQ ID NO: 619 | DNA light chain | GCTATTCAGCTGACTCAGTCACCTAGTAGCCTGAGCGCTAGTG TGGGCGATAGAGTGACTATCACCTGTAAAGCCTCTCAGGACGT GGGCACCGCCGTGGCCTGGTATCTGCAGAAGCCTGGTCAATCA CCTCAGCTGCTGATCTACTGGGCCTCTACTAGACACACCGGCG TGCCCTCTAGGTTTAGCGGTAGCGGTAGTGGCACCGACTTCAC CTTCACTATCTCTTCACTGGAAGCCGAGGACGCCGCTACCTAC TACTGTCAGCAGTATAATAGCTACCCCCTGACCTTCGGTCAAG GCACTAAGGTCGAGATTAAGCGTACGGTGGCCGCTCCCAGCGT GTTCATCTTCCCCCCCAGCGACGAGCAGCTGAAGAGCGGCACC GCCAGCGTGGTGTGCCTGCTGAACAACTTCTACCCCCGGGAGG CCAAGGTGCAGTGGAAGGTGGACAACGCCCTGCAGAGCGGCA ACAGCCAGGAGAGCGTCACCGAGCAGGACAGCAAGGACTCCA CCTACAGCCTGAGCAGCACCCTGACCCTGAGCAAGGCCGACT ACGAGAAGCATAAGGTGTACGCCTGCGAGGTGACCCACCAGG GCCTGTCCAGCCCCGTGACCAAGAGCTTCAACAGGGGCGAGT GC |
| BAP058-Clone N HC | | |
| SEQ ID NO: 601 (Kabat) | HCDR1 | SYWMY |
| SEQ ID NO: 602 (Kabat) | HCDR2 | RIDPNSGSTKYNEKFKN |
| SEQ ID NO: 603 (Kabat) | HCDR3 | DYRKGLYAMDY |
| SEQ ID NO: 604 (Chothia) | HCDR1 | GYTFTSY |
| SEQ ID NO: 605 (Chothia) | HCDR2 | DPNSGS |
| SEQ ID NO: 603 (Chothia) | HCDR3 | DYRKGLYAMDY |
| SEQ ID NO: 620 | VH | EVQLVQSGAEVKKPGATVKISCKVSGYTFTSYWMYWVRQATGQ GLEWMGRIDPNSGSTKYNEKFKNRVTITADKSTSTAYMELSSLRS EDTAVYYCARDYRKGLYAMDYWGQGTTVTVSS |
| SEQ ID NO: 621 | DNA VH | GAAGTGCAGCTGGTGCAGTCAGGCGCCGAAGTGAAGAAACCC GGCGCTACCGTGAAGATTAGCTGTAAAGTCTCAGGCTACACCT TCACTAGCTACTGGATGTACTGGGTCCGACAGGCTACCGGTCA AGGCCTGGAGTGGATGGGTAGAATCGACCCTAATAGCGGCTC TACTAAGTATAACGAGAAGTTTAAGAATAGAGTGACTATCACC GCCGATAAGTCTACTAGCACCGCCTATATGGAACTGTCTAGCC TGAGATCAGAGGACACCGCCGTCTACTACTGCGCTAGAGACTA TAGAAAGGGCCTGTACGCTATGGACTACTGGGGTCAAGGCAC TACCGTGACCGTGTCTTCA |
| SEQ ID NO: 622 | Heavy chain | EVQLVQSGAEVKKPGATVKISCKVSGYTFTSYWMYWVRQATGQ GLEWMGRIDPNSGSTKYNEKFKNRVTITADKSTSTAYMELSSLRS EDTAVYYCARDYRKGLYAMDYWGQGTTVTVSSASTKGPSVFPL APCSRSTSESTAALGCLVKDYFPEPVTVSWNSGALTSGVHTFPAV LQSSGLYSLSSVVTVPSSSLGTKTYTCNVDHKPSNTKVDKRVESK YGPPCPPCPAPEFLGGPSVFLFPPKPKDTLMISRTPEVTCVVVDVS |

TABLE 5-continued

Amino acid and nucleotide sequences of exemplary anti-PD-L1 antibody molecules

| | | |
|---|---|---|
| | | QEDPEVQFNWYVDGVEVHNAKTKPREEQFNSTYRVVSVLTVLH QDWLNGKEYKCKVSNKGLPSSIEKTISKAKGQPREPQVYTLPPSQ EEMTKNQVSLTCLVKGFYPSDIAVEWESNGQPENNYKTTPPVLD SDGSFFLYSRLTVDKSRWQEGNVFSCSVMHEALHNHYTQKSLSL SLG |
| SEQ ID NO: 623 | DNA heavy chain | GAAGTGCAGCTGGTGCAGTCAGGCGCCGAAGTGAAGAAACCC GGCGCTACCGTGAAGATTAGCTGTAAAGTCTCAGGCTACACCT TCACTAGCTACTGGATGTACTGGGTCCGACAGGCTACCGGTCA AGGCCTGGAGTGGATGGGTAGAATCGACCCTAATAGCGGCTC TACTAAGTATAACGAGAAGTTTAAGAATAGAGTGACTATCACC GCCGATAAGTCTACTAGCACCGCCTATATGGAACTGTCTAGCC TGAGATCAGAGGACACCGCCGTCTACTACTGCGCTAGAGACTA TAGAAAGGGCCTGTACGCTATGGACTACTGGGGTCAAGGCAC TACCGTGACCGTGTCTTCAGCTAGCACTAAGGGCCCGTCCGTG TTCCCCCTGGCACCTTGTAGCCGGAGCACTAGCGAATCCACCG CTGCCCTCGGCTGCCTGGTCAAGGATTACTTCCCGGAGCCCGT GACCGTGTCCTGGAACAGCGGAGCCCTGACCTCCGGAGTGCA CACCTTCCCCGCTGTGCTGCAGAGCTCCGGGCTGTACTCGCTG TCGTCGGTGGTCACGGTGCCTTCATCTAGCCTGGGTACCAAGA CCTACACTTGCAACGTGGACCACAAGCCTTCCAACACTAAGGT GGACAAGCGCGTCGAATCGAAGTACGGCCCACCGTGCCCGCC TTGTCCCGCGCCGGAGTTCCTCGGCGGTCCCTCGGTCTTTCTGT TCCCACCGAAGCCCAAGGACACTTTGATGATTTCCCGCACCCC TGAAGTGACATGCGTGGTCGTGGACGTGTCACAGGAAGATCC GGAGGTGCAGTTCAATTGGTACGTGGATGGCGTCGAGGTGCA CAACGCCAAAACCAAGCCGAGGGAGGAGCAGTTCAACTCCAC TTACCGCGTCGTGTCCGTGCTGACGGTGCTGCATCAGGACTGG CTGAACGGGAAGGAGTACAAGTGCAAAGTGTCCAACAAGGGA CTTCCTAGCTCAATCGAAAAGACCATCTCGAAAGCCAAGGGA CAGCCCCGGGAACCCCAAGTGTATACCCTGCCACCGAGCCAG GAAGAAATGACTAAGAACCAAGTCTCATTGACTTGCCTTGTGA AGGGCTTCTACCCATCGGATATCGCCGTGGAATGGGAGTCCAA CGGCCAGCCGGAAAACAACTACAAGACCACCCCTCCGGTGCT GGACTCAGACGGATCCTTCTTCCTCTACTCGCGGCTGACCGTG GATAAGAGCAGATGGCAGGAGGGAAATGTGTTCAGCTGTTCT GTGATGCATGAAGCCCTGCACAACCACTACACTCAGAAGTCCC TGTCCCTCTCCCTGGGA |

BAP058-Clone N LC

| | | |
|---|---|---|
| SEQ ID NO: 609 (Kabat) | LCDR1 | KASQDVGTAVA |
| SEQ ID NO: 610 (Kabat) | LCDR2 | WASTRHT |
| SEQ ID NO: 611(Kabat) | LCDR3 | QQYNSYPLT |
| SEQ ID NO: 612 (Chothia) | LCDR1 | SQDVGTA |
| SEQ ID NO: 613 (Chothia) | LCDR2 | WAS |
| SEQ ID NO: 614 (Chothia) | LCDR3 | YNSYPL |
| SEQ ID NO: 624 | VL | DVVMTQSPLSLPVTLGQPASISCKASQDVGTAVAWYQQKPGQAP RLLIYWASTRHTGVPSRFSGSGSGTEFTLTISSLQPDDFATYYCQQ YNSYPLTFGQGTKVEIK |
| SEQ ID NO: 625 | DNA VL | GACGTCGTGATGACTCAGTCACCCCTGAGCCTGCCCGTGACCC TGGGGCAGCCCGCCTCTATTAGCTGTAAAGCCTCTCAGGACGT GGGCACCGCCGTGGCCTGGTATCAGCAGAAGCCAGGGCAAGC CCCTAGACTGCTGATCTACTGGGCCTCTACTAGACACACCGGC GTGCCCTCTAGGTTTAGCGGTAGCGGTAGTGGCACCGAGTTCA CCCTGACTATCTCTTCACTGCAGCCCGACGACTTCGCTACCTAC TACTGTCAGCAGTATAATAGCTACCCCCTGACCTTCGGTCAAG GCACTAAGGTCGAGATTAAG |
| SEQ ID NO: 626 | Light chain | DVVMTQSPLSLPVTLGQPASISCKASQDVGTAVAWYQQKPGQAP RLLIYWASTRHTGVPSRFSGSGSGTEFTLTISSLQPDDFATYYCQQ YNSYPLTFGQGTKVEIKRTVAAPSVHFPPSDEQLKSGTASVVCLL NNFYPREAKVQWKVDNALQSGNSQESVTEQDSKDSTYSLSSTLT LSKADYEKHKVYACEVTHQGLSSPVTKSFNRGEC |
| SEQ ID NO: 627 | DNA light chain | GACGTCGTGATGACTCAGTCACCCCTGAGCCTGCCCGTGACCC TGGGGCAGCCCGCCTCTATTAGCTGTAAAGCCTCTCAGGACGT |

TABLE 5-continued

Amino acid and nucleotide sequences of exemplary anti-PD-L1 antibody molecules

GGGCACCGCCGTGGCCTGGTATCAGCAGAAGCCAGGGCAAGC
CCCTAGACTGCTGATCTACTGGGCCTCTACTAGACACACCGGC
GTGCCCTCTAGGTTTAGCGGTAGCGGTAGTGGCACCGAGTTCA
CCCTGACTATCTCTTCACTGCAGCCCGACGACTTCGCTACCTAC
TACTGTCAGCAGTATAATAGCTACCCCCTGACCTTCGGTCAAG
GCACTAAGGTCGAGATTAAGCGTACGGTGGCCGCTCCCAGCGT
GTTCATCTTCCCCCCCAGCGACGAGCAGCTGAAGAGCGGCACC
GCCAGCGTGGTGTGCCTGCTGAACAACTTCTACCCCCGGGAGG
CCAAGGTGCAGTGGAAGGTGGACAACGCCCTGCAGAGCGGCA
ACAGCCAGGAGAGCGTCACCGAGCAGGACAGCAAGGACTCCA
CCTACAGCCTGAGCAGCACCCTGACCCTGAGCAAGGCCGACT
ACGAGAAGCATAAGGTGTACGCCTGCGAGGTGACCCACCAGG
GCCTGTCCAGCCCCGTGACCAAGAGCTTCAACAGGGGCGAGT
GC

BAP058-Clone O HC

| SEQ ID NO: 628 (Kabat) | HCDR1 | agctactggatgtac |
| SEQ ID NO: 629 (Kabat) | HCDR2 | agaatcgacccta atagcggctctactaagtataacgagaagtttaagaat |
| SEQ ID NO: 630 (Kabat) | HCDR3 | gactatagaaagggcctgtacgctatggactac |
| SEQ ID NO: 631 (Chothia) | HCDR1 | ggctacaccttcactagctac |
| SEQ ID NO: 632 (Chothia) | HCDR2 | gaccctaatagcggctct |
| SEQ ID NO: 630 (Chothia) | HCDR3 | gactatagaaagggcctgtacgctatggactac |

BAP058-Clone O LC

| SEQ ID NO: 633 (Kabat) | LCDR1 | aaagcctctcaggacgtgggcaccgccgtggcc |
| SEQ ID NO: 634 (Kabat) | LCDR2 | tgggcctctactagacacacc |
| SEQ ID NO: 635 (Kabat) | LCDR3 | cagcagtataatagctacccctgacc |
| SEQ ID NO: 636 (Chothia) | LCDR1 | tctcaggacgtgggcaccgcc |
| SEQ ID NO: 637 (Chothia) | LCDR2 | tgggcctct |
| SEQ ID NO: 638 (Chothia) | LCDR3 | tataatagctacccctg |

BAP058-Clone N HC

| SEQ ID NO: 628 (Kabat) | HCDR1 | agctactggatgtac |
| SEQ ID NO: 629 (Kabat) | HCDR2 | agaatcgacccta atagcggctctactaagtataacgagaagtttaagaat |
| SEQ ID NO: 630 (Kabat) | HCDR3 | gactatagaaagggcctgtacgctatggactac |
| SEQ ID NO: 631 (Chothia) | HCDR1 | ggctacaccttcactagctac |
| SEQ ID NO: 632 (Chothia) | HCDR2 | gaccctaatagcggctct |
| SEQ ID NO: 630 (Chothia) | HCDR3 | gactatagaaagggcctgtacgctatggactac |

BAP058-Clone N LC

| SEQ ID NO: 633 (Kabat) | LCDR1 | aaagcctctcaggacgtgggcaccgccgtggcc |
| SEQ ID NO: 634 (Kabat) | LCDR2 | tgggcctctactagacacacc |
| SEQ ID NO: 635 (Kabat) | LCDR3 | cagcagtataatagctacccctgacc |
| SEQ ID NO: 636 (Chothia) | LCDR1 | tctcaggacgtgggcaccgcc |

TABLE 5-continued

Amino acid and nucleotide sequences of exemplary anti-PD-L1 antibody molecules

| | | |
|---|---|---|
| SEQ ID NO: 637 (Chothia) | LCDR2 | tgggcctct |
| SEQ ID NO: 638 (Chothia) | LCDR3 | tataatagctaccccctg |

Other Exemplary PD-L1 Inhibitors

In one embodiment, the anti-PD-L1 antibody molecule is Atezolizumab (Genentech/Roche), also known as MPDL3280A, RG7446, RO5541267, YW243.55.S70, or TECENTRIQ™. Atezolizumab and other anti-PD-L1 antibodies are disclosed in U.S. Pat. No. 8,217,149, incorporated by reference in its entirety. In one embodiment, the anti-PD-L1 antibody molecule comprises one or more of the CDR sequences (or collectively all of the CDR sequences), the heavy chain or light chain variable region sequence, or the heavy chain or light chain sequence of Atezolizumab, e.g., as disclosed in Table 6.

In one embodiment, the anti-PD-L1 antibody molecule is Avelumab (Merck Serono and Pfizer), also known as MSB0010718C or Bavencio®. Avelumab and other anti-PD-L1 antibodies are disclosed in WO 2013/079174, incorporated by reference in its entirety. In one embodiment, the anti-PD-L1 antibody molecule comprises one or more of the CDR sequences (or collectively all of the CDR sequences), the heavy chain or light chain variable region sequence, or the heavy chain or light chain sequence of Avelumab, e.g., as disclosed in Table 6.

In one embodiment, the anti-PD-L1 antibody molecule is Durvalumab (MedImmune/AstraZeneca), also known as MEDI4736 or Imfinzi®. Durvalumab and other anti-PD-L1 antibodies are disclosed in U.S. Pat. No. 8,779,108, incorporated by reference in its entirety. In one embodiment, the anti-PD-L1 antibody molecule comprises one or more of the CDR sequences (or collectively all of the CDR sequences), the heavy chain or light chain variable region sequence, or the heavy chain or light chain sequence of Durvalumab, e.g., as disclosed in Table 6.

In one embodiment, the anti-PD-L1 antibody molecule is BMS-936559 (Bristol-Myers Squibb), also known as MDX-1105 or 12A4. BMS-936559 and other anti-PD-L1 antibodies are disclosed in U.S. Pat. No. 7,943,743 and WO 2015/081158, incorporated by reference in their entirety. In one embodiment, the anti-PD-L1 antibody molecule comprises one or more of the CDR sequences (or collectively all of the CDR sequences), the heavy chain or light chain variable region sequence, or the heavy chain or light chain sequence of BMS-936559, e.g., as disclosed in Table 6.

Further known anti-PD-L1 antibodies include those described, e.g., in WO 2015/181342, WO 2014/100079, WO 2016/000619, WO 2014/022758, WO 2014/055897, WO 2015/061668, WO 2013/079174, WO 2012/145493, WO 2015/112805, WO 2015/109124, WO 2015/195163, U.S. Pat. Nos. 8,168,179, 8,552,154, 8,460,927, and 9,175,082, incorporated by reference in their entirety.

In one embodiment, the anti-PD-L1 antibody is an antibody that competes for binding with, and/or binds to the same epitope on PD-L1 as, one of the anti-PD-L1 antibodies described herein.

TABLE 6

Amino acid sequences of other exemplary anti-PD-L1 antibody molecules

Atezolizumab

| | | |
|---|---|---|
| SEQ ID NO: 639 | Heavy chain | EVQLVESGGGLVQPGGSLRLSCAASGFTFSDSWIHWVRQAPGKGLEWVAWI SPYGGSTYYADSVKGRFTISADTSKNTAYLQMNSLRAEDTAVYYCARRHWP GGFDYWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKP SNTKVDKKVEPKSCDKTHTCPPCPAPELLGGPSVFLFPPKPKDTLMISRTPEVT CVVVDVSHEDPEVKFNWYVDGVEVHNAKTKPREEQYASTYRVVSVLTVLH QDWLNGKEYKCKVSNKALPAPIEKTISKAKGQPREPQVYTLPPSREEMTKNQ VSLTCLVKGFYPSDIAVEWESNGQPENNYKTTPPVLDSDGSFFLYSKLTVDKS RWQQGNVFSCSVMHEALHNHYTQKSLSLSPGK |
| SEQ ID NO: 640 | Light chain | DIQMTQSPSSLSASVGDRVTITCRASQDVSTAVAWYQQKPGKAPKLLIYSASF LYSGVPSRFSGSGSGTDFTLTISSLQPEDFATYYCQQYLYHPATFGQGTKVEIK RTVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNR GEC |

Avelumab

| | | |
|---|---|---|
| SEQ ID NO: 641 | Heavy chain | EVQLLESGGGLVQPGGSLRLSCAASGFTFSSYIMMWVRQAPGKGLEWVSSIY PSGGITFYADTVKGRFTISRDNSKNTLYLQMNSLRAEDTAVYYCARIKLGTV TTVDYWGQGTLVTVSSASTKGPSVFPLAPSSKSTSGGTAALGCLVKDYFPEP VTVSWNSGALTSGVHTFPAVLQSSGLYSLSSVVTVPSSSLGTQTYICNVNHKP SNTKVDKKVEPKSCDKTHTCPPCPAPELLGGPSVFLFPPKPKDTLMISRTPEVT CVVVDVSHEDPEVKFNWYVDGVEVHNAKTKPREEQYNSTYRVVSVLTVLH QDWLNGKEYKCKVSNKALPAPIEKTISKAKGQPREPQVYTLPPSRDELTKNQ VSLTCLVKGFYPSDIAVEWESNGQPENNYKTTPPVLDSDGSFFLYSKLTVDKS RWQQGNVFSCSVMHEALHNHYTQKSLSLSPGK |

TABLE 6-continued

Amino acid sequences of other exemplary anti-PD-L1 antibody molecules

| SEQ ID NO: 642 | Light chain | QSALTQPASVSGSPGQSITISCTGTSSDVGGYNYVSWYQQHPGKAPKLMIYD<br>VSNRPSGVSNRFSGSKSGNTASLTISGLQAEDEADYYCSSYTSSSTRVFGTGT<br>KVTVLGQPKANPTVTLFPPSSEELQANKATLVCLISDFYPGAVTVAWKADGS<br>PVKAGVETTKPSKQSNNKYAASSYLSLTPEQWKSHRSYSCQVTHEGSTVEKT<br>VAPTECS |
|---|---|---|

Durvalumab

| SEQ ID NO: 643 | Heavy chain | EVQLVESGGGLVQPGGSLRLSCAASGFTFSRYWMSWVRQAPGKGLEWVANI<br>KQDGSEKYYVDSVKGRFTISRDNAKNSLYLQMNSLRAEDTAVYYCAREGG<br>WFGELAFDYWGQGTLVTVSSASTKGPSVFPLAPSSKSTSGGTAALGCLVKDY<br>FPEPVTVSWNSGALTSGVHTFPAVLQSSGLYSLSSVVTVPSSSLGTQTYICNV<br>NHKPSNTKVDKRVEPKSCDKTHTCPPCPAPEFEGGPSVFLFPPKPKDTLMISR<br>TPEVTCVVVDVSHEDPEVKFNWYVDGVEVHNAKTKPREEQYNSTYRVVSV<br>LTVLHQDWLNGKEYKCKVSNKALPASIEKTISKAKGQPREPQVYTLPPSREE<br>MTKNQVSLTCLVKGFYPSDIAVEWESNGQPENNYKTTPPVLDSDGSFFLYSK<br>LTVDKSRWQQGNVFSCSVMHEALHNHYTQKSLSLSPGK |
|---|---|---|
| SEQ ID NO: 644 | Light chain | EIVLTQSPGTLSLSPGERATLSCRASQRVSSSYLAWYQQKPGQAPRLLIYDAS<br>SRATGIPDRFSGSGSGTDFTLTISRLEPEDFAVYYCQQYGSLPWTFGQGTKVEI<br>KRTVAAPSVFIFPPSDEQLKSGTASVVCLLNNFYPREAKVQWKVDNALQSGN<br>SQESVTEQDSKDSTYSLSSTLTLSKADYEKHKVYACEVTHQGLSSPVTKSFNR<br>GEC |

BMS-936559

| SEQ ID NO: 645 | VH | QVQLVQSGAEVKKPGSSVKVSCKTSGDTFSTYAISWVRQAPGQGLEWMGGII<br>PIFGKAHYAQKFQGRVTITADESTSTAYMELSSLRSEDTAVYFCARKFHFVSG<br>SPFGMDVWGQGTTVTVSS |
|---|---|---|
| SEQ ID NO: 646 | VL | EIVLTQSPATLSLSPGERATLSCRASQSVSSYLAWYQQKPGQAPRLLIYDASN<br>RATGIPARFSGSGSGTDFTLTISSLEPEDFAVYYCQQRSNWPTFGQGTKVEIK |

In one embodiment the anti-human ENTPD2 antibody as described herein is administered in combination with at least one PD-L1 inhibitor as described herein and at least one A2A receptor antagonist as described herein.

LAG-3 Inhibitors

In certain embodiments, the anti-human ENTPD2 antibody described herein is administered in combination with a LAG-3 inhibitor. The LAG-3 inhibitor may be an antibody, an antigen-binding fragment thereof, an immunoadhesin, a fusion protein, or oligopeptide. In some embodiments, the LAG-3 inhibitor is chosen from LAG525 (Novartis), BMS-986016 (Bristol-Myers Squibb), TSR-033 (Tesaro), MK-4280 (Merck & Co), or REGN3767 (Regeneron).

Exemplary LAG-3 Inhibitors

In one embodiment, the LAG-3 inhibitor is an anti-LAG-3 antibody molecule. In one embodiment, the LAG-3 inhibitor is an anti-LAG-3 antibody molecule as disclosed in US 2015/0259420, published on Sep. 17, 2015, entitled "Antibody Molecules to LAG-3 and Uses Thereof," incorporated by reference in its entirety.

In one embodiment, the anti-LAG-3 antibody molecule comprises at least one, two, three, four, five or six complementarity determining regions (CDRs) (or collectively all of the CDRs) from a heavy and light chain variable region comprising an amino acid sequence shown in Table 7 (e.g., from the heavy and light chain variable region sequences of BAP050-Clone I or BAP050-Clone J disclosed in Table 7), or encoded by a nucleotide sequence shown in Table 7. In some embodiments, the CDRs are according to the Kabat definition (e.g., as set out in Table 7). In some embodiments, the CDRs are according to the Chothia definition (e.g., as set out in Table 7). In some embodiments, the CDRs are according to the combined CDR definitions of both Kabat and Chothia (e.g., as set out in Table 7). In one embodiment, the combination of Kabat and Chothia CDR of VH CDR1 comprises the amino acid sequence GFTLTNYGMN (SEQ ID NO: 766). In one embodiment, one or more of the CDRs (or collectively all of the CDRs) have one, two, three, four, five, six or more changes, e.g., amino acid substitutions (e.g., conservative amino acid substitutions) or deletions, relative to an amino acid sequence shown in Table 7, or encoded by a nucleotide sequence shown in Table 7.

In one embodiment, the anti-LAG-3 antibody molecule comprises a heavy chain variable region (VH) comprising a VHCDR1 amino acid sequence of SEQ ID NO: 701, a VHCDR2 amino acid sequence of SEQ ID NO: 702, and a VHCDR3 amino acid sequence of SEQ ID NO: 703; and a light chain variable region (VL) comprising a VLCDR1 amino acid sequence of SEQ ID NO: 710, a VLCDR2 amino acid sequence of SEQ ID NO: 711, and a VLCDR3 amino acid sequence of SEQ ID NO: 712, each disclosed in Table 7.

In one embodiment, the anti-LAG-3 antibody molecule comprises a VH comprising a VHCDR1 encoded by the nucleotide sequence of SEQ ID NO: 736 or 737, a VHCDR2 encoded by the nucleotide sequence of SEQ ID NO: 738 or 739, and a VHCDR3 encoded by the nucleotide sequence of SEQ ID NO: 740 or 741; and a VL comprising a VLCDR1 encoded by the nucleotide sequence of SEQ ID NO: 746 or 747, a VLCDR2 encoded by the nucleotide sequence of SEQ ID NO: 748 or 749, and a VLCDR3 encoded by the nucleotide sequence of SEQ ID NO: 750 or 751, each disclosed in Table 7. In one embodiment, the anti-LAG-3 antibody molecule comprises a VH comprising a VHCDR1 encoded by the nucleotide sequence of SEQ ID NO: 758 or 737, a VHCDR2 encoded by the nucleotide sequence of SEQ ID NO: 759 or 739, and a VHCDR3 encoded by the nucleotide sequence of SEQ ID NO: 760 or 741; and a VL comprising a VLCDR1 encoded by the nucleotide sequence of SEQ ID NO: 746 or 747, a VLCDR2 encoded by the nucleotide sequence of SEQ ID NO: 748 or 749, and a VLCDR3 encoded by the nucleotide sequence of SEQ ID NO: 750 or 751, each disclosed in Table 7.

In one embodiment, the anti-LAG-3 antibody molecule comprises a VH comprising the amino acid sequence of SEQ ID NO: 706, or an amino acid sequence at least 85%, 90%, 95%, or 99% identical or higher to SEQ ID NO: 706. In one embodiment, the anti-LAG-3 antibody molecule comprises a VL comprising the amino acid sequence of SEQ ID NO: 718, or an amino acid sequence at least 85%, 90%, 95%, or 99% identical or higher to SEQ ID NO: 718. In one embodiment, the anti-LAG-3 antibody molecule comprises a VH comprising the amino acid sequence of SEQ ID NO: 724, or an amino acid sequence at least 85%, 90%, 95%, or 99% identical or higher to SEQ ID NO: 724. In one embodiment, the anti-LAG-3 antibody molecule comprises a VL comprising the amino acid sequence of SEQ ID NO: 730, or an amino acid sequence at least 85%, 90%, 95%, or 99% identical or higher to SEQ ID NO: 730. In one embodiment, the anti-LAG-3 antibody molecule comprises a VH comprising the amino acid sequence of SEQ ID NO: 706 and a VL comprising the amino acid sequence of SEQ ID NO: 718. In one embodiment, the anti-LAG-3 antibody molecule comprises a VH comprising the amino acid sequence of SEQ ID NO: 724 and a VL comprising the amino acid sequence of SEQ ID NO: 730.

In one embodiment, the antibody molecule comprises a VH encoded by the nucleotide sequence of SEQ ID NO: 707 or 708, or a nucleotide sequence at least 85%, 90%, 95%, or 99% identical or higher to SEQ ID NO: 707 or 708. In one embodiment, the antibody molecule comprises a VL encoded by the nucleotide sequence of SEQ ID NO: 719 or 720, or a nucleotide sequence at least 85%, 90%, 95%, or 99% identical or higher to SEQ ID NO: 719 or 720. In one embodiment, the antibody molecule comprises a VH encoded by the nucleotide sequence of SEQ ID NO: 725 or 726, or a nucleotide sequence at least 85%, 90%, 95%, or 99% identical or higher to SEQ ID NO: 725 or 726. In one embodiment, the antibody molecule comprises a VL encoded by the nucleotide sequence of SEQ ID NO: 731 or 732, or a nucleotide sequence at least 85%, 90%, 95%, or 99% identical or higher to SEQ ID NO: 731 or 732. In one embodiment, the antibody molecule comprises a VH encoded by the nucleotide sequence of SEQ ID NO: 707 or 708 and a VL encoded by the nucleotide sequence of SEQ ID NO: 719 or 720. In one embodiment, the antibody molecule comprises a VH encoded by the nucleotide sequence of SEQ ID NO: 725 or 726 and a VL encoded by the nucleotide sequence of SEQ ID NO: 731 or 732.

In one embodiment, the anti-LAG-3 antibody molecule comprises a heavy chain comprising the amino acid sequence of SEQ ID NO: 709, or an amino acid sequence at least 85%, 90%, 95%, or 99% identical or higher to SEQ ID NO: 709. In one embodiment, the anti-LAG-3 antibody molecule comprises a light chain comprising the amino acid sequence of SEQ ID NO: 721, or an amino acid sequence at least 85%, 90%, 95%, or 99% identical or higher to SEQ ID NO: 721. In one embodiment, the anti-LAG-3 antibody molecule comprises a heavy chain comprising the amino acid sequence of SEQ ID NO: 727, or an amino acid sequence at least 85%, 90%, 95%, or 99% identical or higher to SEQ ID NO: 727. In one embodiment, the anti-LAG-3 antibody molecule comprises a light chain comprising the amino acid sequence of SEQ ID NO: 733, or an amino acid sequence at least 85%, 90%, 95%, or 99% identical or higher to SEQ ID NO: 733. In one embodiment, the anti-LAG-3 antibody molecule comprises a heavy chain comprising the amino acid sequence of SEQ ID NO: 709 and a light chain comprising the amino acid sequence of SEQ ID NO: 721. In one embodiment, the anti-LAG-3 antibody molecule comprises a heavy chain comprising the amino acid sequence of SEQ ID NO: 727 and a light chain comprising the amino acid sequence of SEQ ID NO: 733.

In one embodiment, the antibody molecule comprises a heavy chain encoded by the nucleotide sequence of SEQ ID NO: 716 or 717, or a nucleotide sequence at least 85%, 90%, 95%, or 99% identical or higher to SEQ ID NO: 716 or 717. In one embodiment, the antibody molecule comprises a light chain encoded by the nucleotide sequence of SEQ ID NO: 722 or 723, or a nucleotide sequence at least 85%, 90%, 95%, or 99% identical or higher to SEQ ID NO: 722 or 723. In one embodiment, the antibody molecule comprises a heavy chain encoded by the nucleotide sequence of SEQ ID NO: 728 or 729, or a nucleotide sequence at least 85%, 90%, 95%, or 99% identical or higher to SEQ ID NO: 728 or 729. In one embodiment, the antibody molecule comprises a light chain encoded by the nucleotide sequence of SEQ ID NO: 734 or 735, or a nucleotide sequence at least 85%, 90%, 95%, or 99% identical or higher to SEQ ID NO: 734 or 735. In one embodiment, the antibody molecule comprises a heavy chain encoded by the nucleotide sequence of SEQ ID NO: 716 or 717 and a light chain encoded by the nucleotide sequence of SEQ ID NO: 722 or 723. In one embodiment, the antibody molecule comprises a heavy chain encoded by the nucleotide sequence of SEQ ID NO: 728 or 729 and a light chain encoded by the nucleotide sequence of SEQ ID NO: 734 or 735.

The antibody molecules described herein can be made by vectors, host cells, and methods described in US 2015/0259420, incorporated by reference in its entirety.

TABLE 7

Amino acid and nucleotide sequences of exemplary anti-LAG-3 antibody molecules

BAP050-Clone I HC

| | | |
|---|---|---|
| SEQ ID NO: 701 (Kabat) | HCDR1 | NYGMN |
| SEQ ID NO: 702 (Kabat) | HCDR2 | WINTDTGEPTYADDFKG |
| SEQ ID NO: 703 (Kabat) | HCDR3 | NPPYYYGTNNAEAMDY |
| SEQ ID NO: 704 (Chothia) | HCDR1 | GFTLTNY |
| SEQ ID NO: 705 (Chothia) | HCDR2 | NTDTGE |

TABLE 7-continued

Amino acid and nucleotide sequences of exemplary anti-LAG-3 antibody molecules

| | | |
|---|---|---|
| SEQ ID NO: 703 (Chothia) | HCDR3 | NPPYYYGTNNAEAMDY |
| SEQ ID NO: 706 | VH | QVQLVQSGAEVKKPGASVKVSCKASGFTLTNYGMNWVRQARGQ RLEWIGWINTDTGEPTYADDFKGRFVFSLDTSVSTAYLQISSLKAE DTAVYYCARNPPYYYGTNNAEAMDYWGQGTTVTVSS |
| SEQ ID NO: 707 | DNA VH | CAAGTGCAGCTGGTGCAGTCGGGAGCCGAAGTGAAGAAGCCTG GAGCCTCGGTGAAGGTGTCGTGCAAGGCATCCGGATTCACCCT CACCAATTACGGGATGAACTGGGTCAGACAGGCCCGGGGTCAA CGGCTGGAGTGGATCGGATGGATTAACACCGACACCGGGGAGC CTACCTACGCGGACGATTTCAAGGGACGGTTCGTGTTCTCCCTC GACACCTCCGTGTCCACCGCCTACCTCCAAATCTCCTCACTGAA AGCGGAGGACACCGCCGTGTACTATTGCGCGAGGAACCCGCCC TACTACTACGGAACCAACAACGCCGAAGCCATGGACTACTGGG GCCAGGGCACCACTGTGACTGTGTCCAGC |
| SEQ ID NO: 708 | DNA VH | CAGGTGCAGCTGGTGCAGTCTGGCGCCGAAGTGAAGAAACCTG GCGCCTCCGTGAAGGTGTCCTGCAAGGCCTCTGGCTTCACCCTG ACCAACTACGGCATGAACTGGGTGCGACAGGCCAGGGGCCAGC GGCTGGAATGGATCGGCTGGATCAACACCGACACCGGCGAGCC TACCTACGCCGACGACTTCAAGGGCAGATTCGTGTTCTCCCTGG ACACCTCCGTGTCCACCGCCTACCTGCAGATCTCCAGCCTGAAG GCCGAGGATACCGCCGTGTACTACTGCGCCCGGAACCCCCCTT ACTACTACGGCACCAACAACGCCGAGGCCATGGACTATTGGGG CCAGGGCACCACCGTGACCGTGTCCTCT |
| SEQ ID NO: 709 | Heavy chain | QVQLVQSGAEVKKPGASVKVSCKASGFTLTNYGMNWVRQARGQ RLEWIGWINTDTGEPTYADDFKGRFVFSLDTSVSTAYLQISSLKAE DTAVYYCARNPPYYYGTNNAEAMDYWGQGTTVTVSSASTKGPS VFPLAPCSRSTSESTAALGCLVKDYFPEPVTVSWNSGALTSGVHTF PAVLQSSGLYSLSSVVTVPSSSLGTKTYTCNVDHKPSNTKVDKRV ESKYGPPCPPCPAPEFLGGPSVFLFPPKPKDTLMISRTPEVTCVVVD VSQEDPEVQFNWYVDGVEVHNAKTKPREEQFNSTYRVVSVLTVL HQDWLNGKEYKCKVSNKGLPSSIEKTISKAKGQPREPQVYTLPPS QEEMTKNQVSLTCLVKGFYPSDIAVEWESNGQPENNYKTTPPVLD SDGSFFLYSRLTVDKSRWQEGNVFSCSVMHEALHNHYTQKSLSLS LG |
| SEQ ID NO: 716 | DNA heavy chain | CAAGTGCAGCTGGTGCAGTCGGGAGCCGAAGTGAAGAAGCCTG GAGCCTCGGTGAAGGTGTCGTGCAAGGCATCCGGATTCACCCT CACCAATTACGGGATGAACTGGGTCAGACAGGCCCGGGGTCAA CGGCTGGAGTGGATCGGATGGATTAACACCGACACCGGGGAGC CTACCTACGCGGACGATTTCAAGGGACGGTTCGTGTTCTCCCTC GACACCTCCGTGTCCACCGCCTACCTCCAAATCTCCTCACTGAA AGCGGAGGACACCGCCGTGTACTATTGCGCGAGGAACCCGCCC TACTACTACGGAACCAACAACGCCGAAGCCATGGACTACTGGG GCCAGGGCACCACTGTGACTGTGTCCAGCGCGTCCACTAAGGG CCCGTCCGTGTTCCCCCTGGCACCTTGTAGCCGGAGCACTAGCG AATCCACCGCTGCCCTCGGCTGCCTGGTCAAGGATTACTTCCCG GAGCCCGTGACCGTGTCCTGGAACAGCGGAGCCCTGACCTCCG GAGTGCACACCTTCCCCGCTGTGCTGCAGAGCTCCGGGCTGTAC TCGCTGTCGTCGGTGGTCACGGTGCCTTCATCTAGCCTGGGTAC CAAGACCTACACTTGCAACGTGGACCACAAGCCTTCCAACACT AAGGTGGACAAGCGCGTCGAATCGAAGTACGGCCCACCCGTGCC CGCCTTGTCCCGCGCGGAGTTCCTCGGCGGTCCCTCGGTCTTT CTGTTCCCACCGAAGCCCAAGGACACTTTGATGATTTCCCGCAC CCCTGAAGTGACATGCGTGGTCGTGGACGTGTCACAGGAAGAT CCGGAGGTGCAGTTCAATTGGTACGTGGATGGCGTCGAGGTGC ACAACGCCAAAACCAAGCCGAGGGAGGAGCAGTTCAACTCCAC TTACCGCGTCGTGTCCGTGCTGACGGTGCTGCATCAGGACTGGC TGAACGGGAAGGAGTACAAGTGCAAAGTGTCCAACAAGGGGAC TTCCTAGCTCAATCGAAAAGACCATCTCGAAAGCCAAGGGACA GCCCCGGGAACCCCAAGTGTATACCCTGCCACCGAGCCAGGAA GAAATGACTAAGAACCAAGTCTCATTGACTTGCCTTGTGAAGG GCTTCTACCCATCGGATATCGCCGTGGAATGGGAGTCCAACGG CCAGCCGGAAAACAACTACAAGACCACCCCTCCGGTGCTGGAC TCAGACGGATCCTTCTTCCTCTACTCGCGGCTGACCGTGGATAA GAGCAGATGGCAGGAGGGAAATGTGTTCAGCTGTTCTGTGATG CATGAAGCCCTGCACAACCACTACACTCAGAAGTCCCTGTCCCT CTCCCTGGGA |
| SEQ ID NO: 717 | DNA heavy chain | CAGGTGCAGCTGGTGCAGTCTGGCGCCGAAGTGAAGAAACCTG GCGCCTCCGTGAAGGTGTCCTGCAAGGCCTCTGGCTTCACCCTG ACCAACTACGGCATGAACTGGGTGCGACAGGCCAGGGGCCAGC GGCTGGAATGGATCGGCTGGATCAACACCGACACCGGCGAGCC TACCTACGCCGACGACTTCAAGGGCAGATTCGTGTTCTCCCTGG |

TABLE 7-continued

Amino acid and nucleotide sequences of exemplary anti-LAG-3 antibody molecules

|  |  |  |
|---|---|---|
|  |  | ACACCTCCGTGTCCACCGCCTACCTGCAGATCTCCAGCCTGAAG<br>GCCGAGGATACCGCCGTGTACTACTGCGCCCGGAACCCCCCTT<br>ACTACTACGGCACCAACAACGCCGAGGCCATGGACTATTGGGG<br>CCAGGGCACCACCGTGACCGTGTCCTCTGCTTCTACCAAGGGGC<br>CCAGCGTGTTCCCCCTGGCCCCCTGCTCCAGAAGCACCAGCGA<br>GAGCACAGCCGCCCTGGGCTGCCTGGTGAAGGACTACTTCCCC<br>GAGCCCGTGACCGTGTCCTGGAACAGCGGAGCCCTGACCAGCG<br>GCGTGCACACCTTCCCCGCCGTGCTGCAGAGCAGCGGCCTGTA<br>CAGCCTGAGCAGCGTGGTGACCGTGCCCAGCAGCAGCCTGGGC<br>ACCAAGACCTACACCTGTAACGTGGACCACAAGCCCAGCAACA<br>CCAAGGTGGACAAGAGGGTGGAGAGCAAGTACGGCCCCACCCT<br>GCCCCCCCTGCCCAGCCCCCGAGTTCCTGGGCGGACCCAGCGT<br>GTTCCTGTTCCCCCCCAAGCCCAAGGACACCCTGATGATCAGCA<br>GAACCCCCGAGGTGACCTGTGTGGTGGTGGACGTGTCCCAGGA<br>GGACCCCGAGGTCCAGTTCAACTGGTACGTGGACGGCGTGGAG<br>GTGCACAACGCCAAGACCAAGCCCAGAGAGGAGCAGTTTAACA<br>GCACCTACCGGGTGGTGTCCGTGCTGACCGTGCTGCACCAGGA<br>CTGGCTGAACGGCAAAGAGTACAAGTGTAAGGTCTCCAACAAG<br>GGCCTGCCAAGCAGCATCGAAAAGACCATCAGCAAGGCCAAG<br>GGCCAGCCTAGAGAGCCCCAGGTCTACACCCTGCCACCCAGCC<br>AAGAGGAGATGACCAAGAACCAGGTGTCCCTGACCTGTCTGGT<br>GAAGGGCTTCTACCCAAGCGACATCGCCGTGGAGTGGGAGAGC<br>AACGGCCAGCCCGAGAACAACTACAAGACCACCCCCCCAGTGC<br>TGGACAGCGACGGCAGCTTCTTCCTGTACAGCAGGCTGACCGT<br>GGACAAGTCCAGATGGCAGGAGGGCAACGTCTTTAGCTGCTCC<br>GTGATGCACGAGGCCCTGCACAACCACTACACCCAGAAGAGCC<br>TGAGCCTGTCCCTGGGC |
| BAP050-Clone I LC |  |  |
| SEQ ID NO: 710 (Kabat) | LCDR1 | SSSQDISNYLN |
| SEQ ID NO: 711 (Kabat) | LCDR2 | YTSTLHL |
| SEQ ID NO: 712 (Kabat) | LCDR3 | QQYYNLPWT |
| SEQ ID NO: 713 (Chothia) | LCDR1 | SQDISNY |
| SEQ ID NO: 714 (Chothia) | LCDR2 | YTS |
| SEQ ID NO: 715 (Chothia) | LCDR3 | YYNLPW |
| SEQ ID NO: 718 | VL | DIQMTQSPSSLSASVGDRVTITCSSSQDISNYLNWYLQKPGQSPQL<br>LIYYTSTLHLGVPSRFSGSGSGTEFTLTISSLQPDDFATYYCQQYYN<br>LPWTFGQGTKVEIK |
| SEQ ID NO: 719 | DNA VL | GATATTCAGATGACTCAGTCACCTAGTAGCCTGAGCGCTAGTGT<br>GGGCGATAGAGTGACTATCACCTGTAGCTCTAGTCAGGATATCT<br>CTAACTACCTGAACTGGTATCTGCAGAAGCCCGGTCAATCACCT<br>CAGCTGCTGATCTACTACACTAGCACCCTGCACCTGGGCGTGCC<br>CTCTAGGTTTAGCGGTAGCGGTAGTGGCACCGAGTTCACCCTGA<br>CTATCTCTAGCCTGCAGCCCGACGACTTCGCTACCTACTACTGT<br>CAGCAGTACTATAACCTGCCCTGGACCTTCGGTCAAGGCACTA<br>AGGTCGAGATTAAG |
| SEQ ID NO: 720 | DNA VL | GACATCCAGATGACCCAGTCCCCCTCCAGCCTGTCTGCTTCCGT<br>GGGCGACAGAGTGACCATCACCTGTTCCTCCAGCCAGGACATC<br>TCCAACTACCTGAACTGGTATCTGCAGAAGCCCGGCCAGTCCCC<br>TCAGCTGCTGATCTACTACACACCTCCACCCTGCACCTGGGCGTGC<br>CCTCCAGATTTTCCGGCTCTGGCTCTGGCACCGAGTTTACCCTG<br>ACCATCAGCTCCCTGCAGCCCGACGACTTCGCCACCTACTACTG<br>CCAGCAGTACTACAACCTGCCCTGGACCTTCGGCCAGGGCACC<br>AAGGTGGAAATCAAG |
| SEQ ID NO: 721 | Light chain | DIQMTQSPSSLSASVGDRVTITCSSSQDISNYLNWYLQKPGQSPQL<br>LIYYTSTLHLGVPSRFSGSGSGTEFTLTISSLQPDDFATYYCQQYYN<br>LPWTFGQGTKVEIKRTVAAPSVFIFPPSDEQLKSGTASVVCLLNNF<br>YPREAKVQWKVDNALQSGNSQESVTEQDSKDSTYSLSSTLTLSKA<br>DYEKHKVYACEVTHQGLSSPVTKSFNRGEC |
| SEQ ID NO: 722 | DNA light chain | GATATTCAGATGACTCAGTCACCTAGTAGCCTGAGCGCTAGTGT<br>GGGCGATAGAGTGACTATCACCTGTAGCTCTAGTCAGGATATCT<br>CTAACTACCTGAACTGGTATCTGCAGAAGCCCGGTCAATCACCT<br>CAGCTGCTGATCTACTACACTAGCACCCTGCACCTGGGCGTGCC |

TABLE 7-continued

Amino acid and nucleotide sequences of exemplary anti-LAG-3 antibody molecules

|  |  |  |
|---|---|---|
|  |  | CTCTAGGTTTAGCGGTAGCGGTAGTGGCACCGAGTTCACCCTGA<br>CTATCTCTAGCCTGCAGCCCGACGACTTCGCTACCTACTACTGT<br>CAGCAGTACTATAACCTGCCCTGGACCTTCGGTCAAGGCACTA<br>AGGTCGAGATTAAGCGTACGGTGGCCGCTCCCAGCGTGTTCAT<br>CTTCCCCCCCAGCGACGAGCAGCTGAAGAGCGGCACCGCCAGC<br>GTGGTGTGCCTGCTGAACAACTTCTACCCCCGGGAGGCCAAGG<br>TGCAGTGGAAGGTGGACAACGCCCTGCAGAGCGGCAACAGCCA<br>GGAGAGCGTCACCGAGCAGGACAGCAAGGACTCCACCTACAGC<br>CTGAGCAGCACCCTGACCCTGAGCAAGGCCGACTACGAGAAGC<br>ATAAGGTGTACGCCTGCGAGGTGACCCACCAGGGCCTGTCCAG<br>CCCCGTGACCAAGAGCTTCAACAGGGGCGAGTGC |
| SEQ ID NO: 723 | DNA light chain | GACATCCAGATGACCCAGTCCCCCTCCAGCCTGTCTGCTTCCGT<br>GGGCGACAGAGTGACCATCACCTGTTCCTCCAGCCAGGACATC<br>TCCAACTACCTGAACTGGTATCTGCAGAAGCCCGGCCAGTCCCC<br>TCAGCTGCTGATCTACTACACCTCCACCCTGCACCTGGGCGTGC<br>CCTCCAGATTTTCCGGCTCTGGCTCTGGCACCGAGTTTACCCTG<br>ACCATCAGCTCCCTGCAGCCCGACGACTTCGCCACCTACTACTG<br>CCAGCAGTACTACAACCTGCCCTGGACCTTCGGCCAGGGCACC<br>AAGGTGGAAATCAAGCGTACGGTGGCCGCTCCCAGCGTGTTCA<br>TCTTCCCCCCAAGCGACGAGCAGCTGAAGAGCGGCACCGCCAG<br>CGTGGTGTGTCTGCTGAACAACTTCTACCCCAGGGAGGCCAAG<br>GTGCAGTGGAAGGTGGACAACGCCCTGCAGAGCGGCAACAGCC<br>AGGAGAGCGTCACCGAGCAGGACAGCAAGGACTCCACCTACA<br>GCCTGAGCAGCACCCTGACCCTGAGCAAGGCCGACTACGAGAA<br>GCACAAGGTGTACGCCTGTGAGGTGACCCACCAGGGCCTGTCC<br>AGCCCCGTGACCAAGAGCTTCAACAGGGGCGAGTGC |

BAP050-Clone J HC

| SEQ ID NO: 701 (Kabat) | HCDR1 | NYGMN |
| SEQ ID NO: 702 (Kabat) | HCDR2 | WINTDTGEPTYADDFKG |
| SEQ ID NO: 703 (Kabat) | HCDR3 | NPPYYYGTNNAEAMDY |
| SEQ ID NO: 704 (Chothia) | HCDR1 | GFTLTNY |
| SEQ ID NO: 705 (Chothia) | HCDR2 | NTDTGE |
| SEQ ID NO: 703 (Chothia) | HCDR3 | NPPYYYGTNNAEAMDY |
| SEQ ID NO: 724 | VH | QVQLVQSGAEVKKPGASVKVSCKASGFTLTNYGMNWVRQAPGQ<br>GLEWMGWINTDTGEPTYADDFKGRFVFSLDTSVSTAYLQISSLKA<br>EDTAVYYCARNPPYYYGTNNAEAMDYWGQGTTVTVSS |
| SEQ ID NO: 725 | DNA VH | CAGGTGCAGCTGGTGCAGTCAGGCGCCGAAGTGAAGAAACCCG<br>GCGCTAGTGTGAAAGTCAGCTGTAAAGCTAGTGGCTTCACCCT<br>GACTAACTACGGGATGAACTGGGTCCGCCAGGCCCCAGGTCAA<br>GGCCTCGAGTGGATGGGCTGGATTAACACCGACACCGGCGAGC<br>CTACCTACGCCGACGACTTTAAGGGCAGATTCGTGTTTAGCCTG<br>GACACTAGTGTGTCTACCGCCTACCTGCAGATCTCTAGCCTGAA<br>GGCCGAGGACACCGCCGTCTACTACTGCGCTAGAAACCCCCCC<br>TACTACTACGGCACTAACAACGCCGAGGCTATGGACTACTGGG<br>GTCAAGGCACTACCGTGACCGTGTCTAGC |
| SEQ ID NO: 726 | DNA VH | CAGGTGCAGCTGGTGCAGTCTGGCGCCGAAGTGAAGAAACCTG<br>GCGCCTCCGTGAAGGTGTCCTGCAAGGCCTCTGGCTTCACCCTG<br>ACCAACTACGGCATGAACTGGGTGCGACAGGCCCCTGGACAGG<br>GCCTGGAATGGATGGGCTGGATCAACACCGACACCGGCGAGCC<br>TACCTACGCCGACGACTTCAAGGGCAGATTCGTGTTCTCCCTGG<br>ACACCTCCGTGTCCACCGCCTACCTGCAGATCTCCAGCCTGAAG<br>GCCGAGGATACCGCCGTGTACTACTGCGCCCGGAACCCCCCCTT<br>ACTACTACGGCACCAACAACGCCGAGGCCATGGACTATTGGGG<br>CCAGGGCACCACCGTGACCGTGTCCTCT |
| SEQ ID NO: 727 | Heavy chain | QVQLVQSGAEVKKPGASVKVSCKASGFTLTNYGMNWVRQAPGQ<br>GLEWMGWINTDTGEPTYADDFKGRFVFSLDTSVSTAYLQISSLKA<br>EDTAVYYCARNPPYYYGTNNAEAMDYWGQGTTVTVSSASTKGP<br>SVFPLAPCSRSTSESTAALGCLVKDYFPEPVTVSWNSGALTSGVHT<br>FPAVLQSSGLYSLSSVVTVPSSSLGTKTYTCNVDHKPSNTKVDKRV<br>ESKYGPPCPPCPAPEFLGGPSVFLFPPKPKDTLMISRTPEVTCVVVD<br>VSQEDPEVQFNWYVDGVEVHNAKTKPREEQFNSTYRVVSVLTVL<br>HQDWLNGKEYKCKVSNKGLPSSIEKTISKAKGQPREPQVYTLPPS |

TABLE 7-continued

Amino acid and nucleotide sequences of exemplary anti-LAG-3 antibody molecules

| | | |
|---|---|---|
| | | QEEMTKNQVSLTCLVKGFYPSDIAVEWESNGQPENNYKTTPPVLD SDGSFFLYSRLTVDKSRWQEGNVFSCSVMHEALHNHYTQKSLSLS LG |
| SEQ ID NO: 728 | DNA heavy chain | CAGGTGCAGCTGGTGCAGTCAGGCGCCGAAGTGAAGAAACCCG GCGCTAGTGTGAAAGTCAGCTGTAAAGCTAGTGGCTTCACCCT GACTAACTACGGGATGAACTGGGTCCGCCAGGCCCCAGGTCAA GGCCTCGAGTGGATGGGCTGGATTAACACCGACACCGGCGAGC CTACCTACGCCGACGACTTTAAGGGCAGATTCGTGTTTAGCCTG GACACTAGTGTGTCTACCGCCTACCTGCAGATCTCTAGCCTGAA GGCCGAGGACACCGCCGTCTACTACTGCGCTAGAAACCCCCCC TACTACTACGGCACTAACAACGCCGAGGCTATGGACTACTGGG GTCAAGGCACTACCGTGACCGTGTCTAGCGCTAGCACTAAGGG CCCGTCCGTGTTCCCCCTGGCACCTTGTAGCCGGAGCACTAGCG AATCCACCGCTGCCCTCGGCTGCCTGGTCAAGGATTACTTCCCG GAGCCCGTGACCGTGTCCTGGAACAGCGGAGCCCTGACCTCCG GAGTGCACACCTTCCCCGCTGTGCTGCAGAGCTCCGGGCTGTAC TCGCTGTCGTCGGTGGTCACGGTGCCCTTCATCTAGCCTGGGTAC CAAGACCTACACTTGCAACGTGGACCACAAGCCTTCCAACACT AAGGTGGACAAGCGCGTCGAATCGAAGTACGGCCCACCGTGCC CGCCTTGTCCCGCGCCGGAGTTCCTCGGCGGTCCCTCGGTCTTT CTGTTCCCACCGAAGCCCAAGGACACTTTGATGATTTCCCGCAC CCCTGAAGTGACATGCGTGGTCGTGGACGTGTCACAGGAAGAT CCGGAGGTGCAGTTCAATTGGTACGTGGATGGCGTCGAGGTGC ACAACGCCAAAACCAAGCCGAGGGAGGAGCAGTTCAACTCCAC TTACCGCGTCGTGTCCGTGCTGACGGTGCTGCATCAGGACTGGC TGAACGGGAAGGAGTACAAGTGCAAAGTGTCCAACAAGGGAC TTCCTAGCTCAATCGAAAAGACCATCTCGAAAGCCAAGGGACA GCCCCGGGAACCCCAAGTGTATACCCTGCCACCGAGCCAGGAA GAAATGACTAAGAACCAAGTCTCATTGACTTGCCTTGTGAAGG GCTTCTACCCATCGGATATCGCCGTGGAATGGGAGTCCAACGG CCAGCCGGAAAACAACTACAAGACCACCCCTCCGGTGCTGGAC TCAGACGGATCCTTCTTCCTCTACTCGCGGCTGACCGTGGATAA GAGCAGATGGCAGGAGGGAAATGTGTTCAGCTGTTCTGTGATG CATGAAGCCCTGCACAACCACTACACTCAGAAGTCCCTGTCCCT CTCCCTGGGA |
| SEQ ID NO: 729 | DNA heavy chain | CAGGTGCAGCTGGTGCAGTCTGGCGCCGAAGTGAAGAAACCTG GCGCCTCCGTGAAGGTGTCCTGCAAGGCCTCTGGCTTCACCCTG ACCAACTACGGCATGAACTGGGTGCGACAGGCCCCTGGACAGG GCCTGGAATGGATGGGCTGGATCAACACCGACACCGGCGAGCC TACCTACGCCGACGACTTCAAGGGCAGATTCGTGTTCTCCCTGG ACACCTCCGTGTCCACCGCCTACCTGCAGATCTCCAGCCTGAAG GCCGAGGATACCGCCGTGTACTACTGCGCCCGGAACCCCCCTT ACTACTACGGCACCAACAACGCCGAGGCATGGACTATTGGGG CCAGGGCACCACCGTGACCGTGTCCTCTGCTTCTACCAAGGGGC CCAGCGTGTTCCCCCTGGCCCCCTGCTCCAGAAGCACCAGCGA GAGCACAGCCGCCCTGGGCTGCCTGGTGAAGGACTACTTCCCC GAGCCCGTGACCGTGTCCTGGAACAGCGGAGCCCTGACCAGCG GCGTGCACACCTTCCCCGCCGTGCTGCAGAGCAGCGGCCTGTA CAGCCTGAGCAGCGTGGTGACCGTGCCCAGCAGCAGCCTGGGC ACCAAGACCTACACCTGTAACGTGGACCACAAGCCCAGCAACA CCAAGGTGGACAAGAGGGTGGAGAGCAAGTACGGCCCACCCT GCCCCCCCTGCCCAGCCCCCGAGTTCCTGGGCGGACCCAGCGT GTTCCTGTTCCCCCCCAAGCCCAAGGACACCCTGATGATCAGCA GAACCCCCGAGGTGACCTGTGTGGTGGTGGACGTGTCCCAGGA GGACCCCGAGGTCCAGTTCAACTGGTACGTGGACGGCGTGGAG GTGCACAACGCCAAGACCAAGCCCAGAGAGGAGCAGTTTAACA GCACCTACCGGGTGGTGTCCGTGCTGACCGTGCTGCACCAGGA CTGGCTGAACGGCAAAGAGTACAAGTGTAAGGTCTCCAACAAG GGCCTGCCAAGCAGCATCGAAAAGACCATCAGCAAGGCCAAG GGCCAGCCTAGAGAGCCCCAGGTCTACACCCTGCCACCCAGCC AAGAGGAGATGACCAAGAACCAGGTGTCCCTGACCTGTCTGGT GAAGGGCTTCTACCCAAGCGACATCGCCGTGGAGTGGGAGAGC AACGGCCAGCCCGAGAACAACTACAAGACCACCCCCCCAGTGC TGGACAGCGACGGCAGCTTCTTCCTGTACAGCAGGCTGACCGT GGACAAGTCCAGATGGCAGGAGGGCAACGTCTTTAGCTGCTCC GTGATGCACGAGGCCCTGCACAACCACTACACCCAGAAGAGCC TGAGCCTGTCCCTGGGC |
| BAP050-Clone J LC | | |
| SEQ ID NO: 710 (Kabat) | LCDR1 | SSSQDISNYLN |
| SEQ ID NO: 711 (Kabat) | LCDR2 | YTSTLHL |
| SEQ ID NO: 712 (Kabat) | LCDR3 | QQYYNLPWT |

TABLE 7-continued

Amino acid and nucleotide sequences of exemplary anti-LAG-3 antibody molecules

| SEQ ID NO: 713 (Chothia) | LCDR1 | SQDISNY |
|---|---|---|
| SEQ ID NO: 714 (Chothia) | LCDR2 | YTS |
| SEQ ID NO: 715 (Chothia) | LCDR3 | YYNLPW |
| SEQ ID NO: 730 | VL | DIQMTQSPSSLSASVGDRVTITCSSSQDISNYLNWYQQKPGKAPKL LIYYTSTLHLGIPPRFSGSGYGTDFTLTINNIESEDAAYYFCQQYYN LPWTFGQGTKVEIK |
| SEQ ID NO: 731 | DNA VL | GATATTCAGATGACTCAGTCACCTAGTAGCCTGAGCGCTAGTGT GGGCGATAGAGTGACTATCACCTGTAGCTCTAGTCAGGATATCT CTAACTACCTGAACTGGTATCAGCAGAAGCCCGGTAAAGCCCC TAAGCTGCTGATCTACTACACTAGCACCCTGCACCTGGGAATCC CCCCTAGGTTTAGCGGTAGCGGCTACGGCACCGACTTCACCCTG ACTATTAACAATATCGAGTCAGAGGACGCCGCCTACTACTTCTG TCAGCAGTACTATAACCTGCCCTGGACCTTCGGTCAAGGCACTA AGGTCGAGATTAAG |
| SEQ ID NO: 732 | DNA VL | GACATCCAGATGACCCAGTCCCCCTCCAGCCTGTCTGCTTCCGT GGGCGACAGAGTGACCATCACCTGTTCCTCCAGCCAGGACATC TCCAACTACCTGAACTGGTATCAGCAGAAGCCCGGCAAGGCCC CAAGCTGCTGATCTACTACACCTCCACCCTGCACCTGGGCATC CCCCCTAGATTCTCCGGCTCTGGCTACGGCACCGACTTCACCCT GACCATCAACAACATCGAGTCCGAGGACGCCGCCTACTACTTC TGCCAGCAGTACTACAACCTGCCCTGGACCTTCGGCCAGGGCA CCAAGGTGGAAATCAAG |
| SEQ ID NO: 733 | Light chain | DIQMTQSPSSLSASVGDRVTITCS SQDISNYLNWYQQKPGKAPKL LIYYTSTLHLGIPPRFSGSGYGTDFTLTINNIESEDAAYYFCQQYYN LPWTFGQGTKVEIKRTVAAPSVFIFPPSDEQLKSGTASVVCLLNNF YPREAKVQWKVDNALQSGNSQESVTEQDSKDSTYSLSSTLTLSKA DYEKHKVYACEVTHQGLSSPVTKSFNRGEC |
| SEQ ID NO: 734 | DNA light chain | GATATTCAGATGACTCAGTCACCTAGTAGCCTGAGCGCTAGTGT GGGCGATAGAGTGACTATCACCTGTAGCTCTAGTCAGGATATCT CTAACTACCTGAACTGGTATCAGCAGAAGCCCGGTAAAGCCCC TAAGCTGCTGATCTACTACACTAGCACCCTGCACCTGGGAATCC CCCCTAGGTTTAGCGGTAGCGGCTACGGCACCGACTTCACCCTG ACTATTAACAATATCGAGTCAGAGGACGCCGCCTACTACTTCTG TCAGCAGTACTATAACCTGCCCTGGACCTTCGGTCAAGGCACTA AGGTCGAGATTAAGCGTACGGTGGCCGCTCCCAGCGTGTTCAT CTTCCCCCCCAGCGACGAGCAGCTGAAGAGCGGCACCGCCAGC GTGGTGTGCCTGCTGAACAACTTCTACCCCCGGGAGGCCAAGG TGCAGTGGAAGGTGGACAACGCCCTGCAGAGCGGCAACAGCCA GGAGAGCGTCACCGAGCAGGACAGCAAGGACTCCACCTACAGC CTGAGCAGCACCCTGACCCTGAGCAAGGCCGACTACGAGAAGC ATAAGGTGTACGCCTGCGAGGTGACCCACCAGGGCCTGTCCAG CCCCGTGACCAAGAGCTTCAACAGGGGCGAGTGC |
| SEQ ID NO: 735 | DNA light chain | GACATCCAGATGACCCAGTCCCCCTCCAGCCTGTCTGCTTCCGT GGGCGACAGAGTGACCATCACCTGTTCCTCCAGCCAGGACATC TCCAACTACCTGAACTGGTATCAGCAGAAGCCCGGCAAGGCCC CAAGCTGCTGATCTACTACACCTCCACCCTGCACCTGGGCATC CCCCCTAGATTCTCCGGCTCTGGCTACGGCACCGACTTCACCCT GACCATCAACAACATCGAGTCCGAGGACGCCGCCTACTACTTC TGCCAGCAGTACTACAACCTGCCCTGGACCTTCGGCCAGGGCA CCAAGGTGGAAATCAAGCGTACGGTGGCCGCTCCCAGCGTGTT CATCTTCCCCCCAAGCGACGAGCAGCTGAAGAGCGGCACCGCC AGCGTGGTGTGTCTGCTGAACAACTTCTACCCCAGGGAGGCCA AGGTGCAGTGGAAGGTGGACAACGCCCTGCAGAGCGGCAACA GCCAGGAGAGCGTCACCGAGCAGGACAGCAAGGACTCCACCTA CAGCCTGAGCAGCACCCTGACCCTGAGCAAGGCCGACTACGAG AAGCACAAGGTGTACGCCTGTGAGGTGACCCACCAGGGCCTGT CCAGCCCCGTGACCAAGAGCTTCAACAGGGGCGAGTGC |
| BAP050-Clone I HC | | |
| SEQ ID NO: 736 (Kabat) | HCDR1 | AATTACGGGATGAAC |
| SEQ ID NO: 737 (Kabat) | HCDR1 | AACTACGGCATGAAC |

TABLE 7-continued

Amino acid and nucleotide sequences of exemplary anti-LAG-3 antibody molecules

| | | |
|---|---|---|
| SEQ ID NO: 738 (Kabat) | HCDR2 | TGGATTAACACCGACACCGGGGAGCCTACCTACGCGGACGATT TCAAGGGA |
| SEQ ID NO: 739 (Kabat) | HCDR2 | TGGATCAACACCGACACCGGCGAGCCTACCTACGCCGACGACT TCAAGGGC |
| SEQ ID NO: 740 (Kabat) | HCDR3 | AACCCGCCCTACTACTACGGAACCAACAACGCCGAAGCCATGG ACTAC |
| SEQ ID NO: 741 (Kabat) | HCDR3 | AACCCCCCTTACTACTACGGCACCAACAACGCCGAGGCCATGG ACTAT |
| SEQ ID NO: 742 (Chothia) | HCDR1 | GGATTCACCCTCACCAATTAC |
| SEQ ID NO: 743 (Chothia) | HCDR1 | GGCTTCACCCTGACCAACTAC |
| SEQ ID NO: 744 (Chothia) | HCDR2 | AACACCGACACCGGGGAG |
| SEQ ID NO: 745 (Chothia) | HCDR2 | AACACCGACACCGGCGAG |
| SEQ ID NO: 740 (Chothia) | HCDR3 | AACCCGCCCTACTACTACGGAACCAACAACGCCGAAGCCATGG ACTAC |
| SEQ ID NO: 741 (Chothia) | HCDR3 | AACCCCCCTTACTACTACGGCACCAACAACGCCGAGGCCATGG ACTAT |
| BAP050-Clone I LC | | |
| SEQ ID NO: 746 (Kabat) | LCDR1 | AGCTCTAGTCAGGATATCTCTAACTACCTGAAC |
| SEQ ID NO: 747 (Kabat) | LCDR1 | TCCTCCAGCCAGGACATCTCCAACTACCTGAAC |
| SEQ ID NO: 748 (Kabat) | LCDR2 | TACACTAGCACCCTGCACCTG |
| SEQ ID NO: 749 (Kabat) | LCDR2 | TACACCTCCACCCTGCACCTG |
| SEQ ID NO: 750 (Kabat) | LCDR3 | CAGCAGTACTATAACCTGCCCTGGACC |
| SEQ ID NO: 751 (Kabat) | LCDR3 | CAGCAGTACTACAACCTGCCCTGGACC |
| SEQ ID NO: 752 (Chothia) | LCDR1 | AGTCAGGATATCTCTAACTAC |
| SEQ ID NO: 753 (Chothia) | LCDR1 | AGCCAGGACATCTCCAACTAC |
| SEQ ID NO: 754 (Chothia) | LCDR2 | TACACTAGC |
| SEQ ID NO: 755 (Chothia) | LCDR2 | TACACCTCC |
| SEQ ID NO: 756 (Chothia) | LCDR3 | TACTATAACCTGCCCTGG |
| SEQ ID NO: 757 (Chothia) | LCDR3 | TACTACAACCTGCCCTGG |
| BAP050-Clone J HC | | |
| SEQ ID NO: 758 (Kabat) | HCDR1 | AACTACGGGATGAAC |
| SEQ ID NO: 737 (Kabat) | HCDR1 | AACTACGGCATGAAC |
| SEQ ID NO: 759 (Kabat) | HCDR2 | TGGATTAACACCGACACCGGCGAGCCTACCTACGCCGACGACT TTAAGGGC |
| SEQ ID NO: 739 (Kabat) | HCDR2 | TGGATCAACACCGACACCGGCGAGCCTACCTACGCCGACGACT TCAAGGGC |
| SEQ ID NO: 760 (Kabat) | HCDR3 | AACCCCCCCTACTACTACGGCACTAACAACGCCGAGGCTATGG ACTAC |

TABLE 7-continued

Amino acid and nucleotide sequences of exemplary anti-LAG-3 antibody molecules

| | | |
|---|---|---|
| SEQ ID NO: 741 (Kabat) | HCDR3 | AACCCCCCTTACTACTACGGCACCAACAACGCCGAGGCCATGGACTAT |
| SEQ ID NO: 761 (Chothia) | HCDR1 | GGCTTCACCCTGACTAACTAC |
| SEQ ID NO: 743 (Chothia) | HCDR1 | GGCTTCACCCTGACCAACTAC |
| SEQ ID NO: 744 (Chothia) | HCDR2 | AACACCGACACCGGGGAG |
| SEQ ID NO: 745 (Chothia) | HCDR2 | AACACCGACACCGGCGAG |
| SEQ ID NO: 760 (Chothia) | HCDR3 | AACCCCCCCTACTACTACGGCACTAACAACGCCGAGGCTATGGACTAC |
| SEQ ID NO: 741 (Chothia) | HCDR3 | AACCCCCCTTACTACTACGGCACCAACAACGCCGAGGCCATGGACTAT |

BAP050-Clone J LC

| | | |
|---|---|---|
| SEQ ID NO: 746 (Kabat) | LCDR1 | AGCTCTAGTCAGGATATCTCTAACTACCTGAAC |
| SEQ ID NO: 747 (Kabat) | LCDR1 | TCCTCCAGCCAGGACATCTCCAACTACCTGAAC |
| SEQ ID NO: 748 (Kabat) | LCDR2 | TACACTAGCACCCTGCACCTG |
| SEQ ID NO: 749 (Kabat) | LCDR2 | TACACCTCCACCCTGCACCTG |
| SEQ ID NO: 750 (Kabat) | LCDR3 | CAGCAGTACTATAACCTGCCCTGGACC |
| SEQ ID NO: 751 (Kabat) | LCDR3 | CAGCAGTACTACAACCTGCCCTGGACC |
| SEQ ID NO: 752 (Chothia) | LCDR1 | AGTCAGGATATCTCTAACTAC |
| SEQ ID NO: 753 (Chothia) | LCDR1 | AGCCAGGACATCTCCAACTAC |
| SEQ ID NO: 754 (Chothia) | LCDR2 | TACACTAGC |
| SEQ ID NO: 755 (Chothia) | LCDR2 | TACACCTCC |
| SEQ ID NO: 756 (Chothia) | LCDR3 | TACTATAACCTGCCCTGG |
| SEQ ID NO: 757 (Chothia) | LCDR3 | TACTACAACCTGCCCTGG |

Other Exemplary LAG-3 Inhibitors

In one embodiment, the anti-LAG-3 antibody molecule is BMS-986016 (Bristol-Myers Squibb), also known as BMS986016. BMS-986016 and other anti-LAG-3 antibodies are disclosed in WO 2015/116539 and U.S. Pat. No. 9,505,839, incorporated by reference in their entirety. In one embodiment, the anti-LAG-3 antibody molecule comprises one or more of the CDR sequences (or collectively all of the CDR sequences), the heavy chain or light chain variable region sequence, or the heavy chain or light chain sequence of BMS-986016, e.g., as disclosed in Table 8.

In one embodiment, the anti-LAG-3 antibody molecule is TSR-033 (Tesaro). In one embodiment, the anti-LAG-3 antibody molecule comprises one or more of the CDR sequences (or collectively all of the CDR sequences), the heavy chain or light chain variable region sequence, or the heavy chain or light chain sequence of TSR-033.

In one embodiment, the anti-LAG-3 antibody molecule is MK-4280 (Merck & Co). In one embodiment, the anti-LAG-3 antibody molecule comprises one or more of the CDR sequences (or collectively all of the CDR sequences), the heavy chain or light chain variable region sequence, or the heavy chain or light chain sequence of MK-4280.

In one embodiment, the anti-LAG-3 antibody molecule is REGN3767 (Regeneron). In one embodiment, the anti-LAG-3 antibody molecule comprises one or more of the CDR sequences (or collectively all of the CDR sequences), the heavy chain or light chain variable region sequence, or the heavy chain or light chain sequence of REGN3767.

In one embodiment, the anti-LAG-3 antibody molecule is IMP731 or GSK2831781 (GSK and Prima BioMed). IMP731 and other anti-LAG-3 antibodies are disclosed in WO 2008/132601 and U.S. Pat. No. 9,244,059, incorporated by reference in their entirety. In one embodiment, the anti-LAG-3 antibody molecule comprises one or more of the CDR sequences (or collectively all of the CDR sequences), the heavy chain or light chain variable region sequence, or the heavy chain or light chain sequence of IMP731, e.g., as disclosed in Table 8. In one embodiment, the anti-LAG-3 antibody molecule comprises one or more of the CDR sequences (or collectively all of the CDR sequences), the heavy chain or light chain variable region sequence, or the heavy chain or light chain sequence of GSK2831781.

In one embodiment, the anti-LAG-3 antibody molecule is IMP761 (Prima BioMed). In one embodiment, the anti-LAG-3 antibody molecule comprises one or more of the CDR sequences (or collectively all of the CDR sequences), the heavy chain or light chain variable region sequence, or the heavy chain or light chain sequence of IMP761.

Further known anti-LAG-3 antibodies include those described, e.g., in WO 2008/132601, WO 2010/019570, WO 2014/140180, WO 2015/116539, WO 2015/200119, WO 2016/028672, U.S. Pat. Nos. 9,244,059, 9,505,839, incorporated by reference in their entirety.

In one embodiment, the anti-LAG-3 antibody is an antibody that competes for binding with, and/or binds to the same epitope on LAG-3 as, one of the anti-LAG-3 antibodies described herein.

In one embodiment, the anti-LAG-3 inhibitor is a soluble LAG-3 protein, e.g., IMP321 (Prima BioMed), e.g., as disclosed in WO 2009/044273, incorporated by reference in its entirety.

antibody, an antigen-binding fragment thereof, an immunoadhesin, a fusion protein, or an oligopeptide. In some embodiments, the TIM-3 inhibitor is chosen from MBG453 (Novartis), TSR-022 (Tesaro) or LY3321367 (Eli Lilly).

Exemplary TIM-3 Inhibitors

In one embodiment, the TIM-3 inhibitor is an anti-TIM-3 antibody molecule. In one embodiment, the TIM-3 inhibitor is an anti-TIM-3 antibody molecule as disclosed in US 2015/0218274, published on Aug. 6, 2015, entitled "Antibody Molecules to TIM-3 and Uses Thereof," incorporated by reference in its entirety.

In one embodiment, the anti-TIM-3 antibody molecule comprises at least one, two, three, four, five or six complementarity determining regions (CDRs) (or collectively all of the CDRs) from a heavy and light chain variable region comprising an amino acid sequence shown in Table 9 (e.g., from the heavy and light chain variable region sequences of ABTIM3-hum11 or ABTIM3-hum03 disclosed in Table 9), or encoded by a nucleotide sequence shown in Table 9. In some embodiments, the CDRs are according to the Kabat definition (e.g., as set out in Table 9). In some embodiments, the CDRs are according to the Chothia definition (e.g., as set out in Table 9). In one embodiment, one or more of the CDRs (or collectively all of the CDRs) have one, two, three, four, five, six or more changes, e.g., amino acid substitutions (e.g., conservative amino acid substitutions) or deletions,

TABLE 8

Amino acid sequences of other exemplary anti-LAG-3 antibody molecules

BMS-986016

SEQ ID NO: 762 Heavy chain QVQLQQWGAGLLKPSETLSLTCAVYGGSFSDYYWNWIRQPPGKGLE
WIGEINHRGSTNSNPSLKSRVTLSLDTSKNQFSLKLRSVTAADTAVYYC
AFGYSDYEYNWFDPWGQGTLVTVSSASTKGPSVFPLAPCSRSTSESTA
ALGCLVKDYFPEPVTVSWNSGALTSGVHTFPAVLQSSGLYSLSSVVTV
PSSSLGTKTYTCNVDHKPSNTKVDKRVESKYGPPCPPCPAPEFLGGPSV
FLFPPKPKDTLMISRTPEVTCVVVDVSQEDPEVQFNWYVDGVEVHNA
KTKPREEQFNSTYRVVSVLTVLHQDWLNGKEYKCKVSNKGLPSSIEKT
ISKAKGQPREPQVYTLPPSQEEMTKNQVSLTCLVKGFYPSDIAVEWES
NGQPENNYKTTPPVLDSDGSFFLYSRLTVDKSRWQEGNVFSCSVMHE
ALHNHYTQKSLSLSLGK SEQ ID NO: 763 Light chain EIVLTQSPATLSLSPGERATLSCRASQSISSYLAWYQQKPGQAPRLLIYD
ASNRATGIPARFSGSGSGTDFTLTISSLEPEDFAVYYCQQRSNWPLTFG
QGTNLEIKRTVAAPSVFIFPPSDEQLKSGTASVVCLLNNFYPREAKVQW
KVDNALQSGNSQESVTEQDSKDSTYSLSSTLTLSKADYEKHKVYACE
VTHQGLSSPVTKSFNRGEC

IMP731

SEQ ID NO: 764 Heavy chain QVQLKESGPGLVAPSQSLSITCTVSGFSLTAYGVNWVRQPPGKGLEWL
GMIWDDGSTDYNSALKSRLSISKDNSKSQVFLKMNSLQTDDTARYYC
AREGDVAFDYWGQGTTLTVSSASTKGPSVFPLAPSSKSTSGGTAALGC
LVKDYFPEPVTVSWNSGALTSGVHTFPAVLQSSGLYSLSSVVTVPSSSL
GTQTYICNVNHKPSNTKVDKKVEPKSCDKTHTCPPCPAPELLGGPSVF
LFPPKPKDTLMISRTPEVTCVVVDVSHEDPEVKFNWYVDGVEVHNAK
TKPREEQYNSTYRVVSVLTVLHQDWLNGKEYKCKVSNKALPAPIEKTI
SKAKGQPREPQVYTLPPSRDELTKNQVSLTCLVKGFYPSDIAVEWESN
GQPENNYKTTPPVLDSDGSFFLYSKLTVDKSRWQQGNVFSCSVMHEA
LHNHYTQKSLSLSPGK SEQ ID NO: 765 Light chain DIVMTQSPSSLAVSVGQKVTMSCKSSQSLLNGSNQKNYLAWYQQKPG
QSPKLLVYFASTRDSGVPDRFIGSGSGTDFTLTISSVQAEDLADYFCLQ
HFGTPPTFGGGTKLEIKRTVAAPSVFIFPPSDEQLKSGTASVVCLLNNFY
PREAKVQWKVDNALQSGNSQESVTEQDSKDSTYSLSSTLTLSKADYE
KHKVYACEVTHQGLSSPVTKSFNRGEC TIM-3 Inhibitors In certain embodiments, the anti-human ENTPD2 antibody as described herein is administered in combination with a TIM-3 inhibitor. The TIM-3 inhibitor may be an relative to an amino acid sequence shown in Table 9, or encoded by a nucleotide sequence shown in Table 9.

In one embodiment, the anti-TIM-3 antibody molecule comprises a heavy chain variable region (VH) comprising a VHCDR1 amino acid sequence of SEQ ID NO: 801, a VHCDR2 amino acid sequence of SEQ ID NO: 802, and a VHCDR3 amino acid sequence of SEQ ID NO: 803; and a light chain variable region (VL) comprising a VLCDR1 amino acid sequence of SEQ ID NO: 810, a VLCDR2 amino acid sequence of SEQ ID NO: 811, and a VLCDR3 amino acid sequence of SEQ ID NO: 812, each disclosed in Table 9. In one embodiment, the anti-TIM-3 antibody molecule comprises a heavy chain variable region (VH) comprising a VHCDR1 amino acid sequence of SEQ ID NO: 801, a VHCDR2 amino acid sequence of SEQ ID NO: 820, and a VHCDR3 amino acid sequence of SEQ ID NO: 803; and a light chain variable region (VL) comprising a VLCDR1 amino acid sequence of SEQ ID NO: 810, a VLCDR2 amino acid sequence of SEQ ID NO: 811, and a VLCDR3 amino acid sequence of SEQ ID NO: 812, each disclosed in Table 9.

In one embodiment, the anti-TIM-3 antibody molecule comprises a VH comprising the amino acid sequence of SEQ ID NO: 806, or an amino acid sequence at least 85%, 90%, 95%, or 99% identical or higher to SEQ ID NO: 806. In one embodiment, the anti-TIM-3 antibody molecule comprises a VL comprising the amino acid sequence of SEQ ID NO: 816, or an amino acid sequence at least 85%, 90%, 95%, or 99% identical or higher to SEQ ID NO: 816. In one embodiment, the anti-TIM-3 antibody molecule comprises a VH comprising the amino acid sequence of SEQ ID NO: 822, or an amino acid sequence at least 85%, 90%, 95%, or 99% identical or higher to SEQ ID NO: 822. In one embodiment, the anti-TIM-3 antibody molecule comprises a VL comprising the amino acid sequence of SEQ ID NO: 826, or an amino acid sequence at least 85%, 90%, 95%, or 99% identical or higher to SEQ ID NO: 826. In one embodiment, the anti-TIM-3 antibody molecule comprises a VH comprising the amino acid sequence of SEQ ID NO: 806 and a VL comprising the amino acid sequence of SEQ ID NO: 816. In one embodiment, the anti-TIM-3 antibody molecule comprises a VH comprising the amino acid sequence of SEQ ID NO: 822 and a VL comprising the amino acid sequence of SEQ ID NO: 826.

In one embodiment, the antibody molecule comprises a VH encoded by the nucleotide sequence of SEQ ID NO: 807, or a nucleotide sequence at least 85%, 90%, 95%, or 99% identical or higher to SEQ ID NO: 807. In one embodiment, the antibody molecule comprises a VL encoded by the nucleotide sequence of SEQ ID NO: 817, or a nucleotide sequence at least 85%, 90%, 95%, or 99% identical or higher to SEQ ID NO: 817. In one embodiment, the antibody molecule comprises a VH encoded by the nucleotide sequence of SEQ ID NO: 823, or a nucleotide sequence at least 85%, 90%, 95%, or 99% identical or higher to SEQ ID NO: 823. In one embodiment, the antibody molecule comprises a VL encoded by the nucleotide sequence of SEQ ID NO: 827, or a nucleotide sequence at least 85%, 90%, 95%, or 99% identical or higher to SEQ ID NO: 827. In one embodiment, the antibody molecule comprises a VH encoded by the nucleotide sequence of SEQ ID NO: 807 and a VL encoded by the nucleotide sequence of SEQ ID NO: 817. In one embodiment, the antibody molecule comprises a VH encoded by the nucleotide sequence of SEQ ID NO: 823 and a VL encoded by the nucleotide sequence of SEQ ID NO: 827.

In one embodiment, the anti-TIM-3 antibody molecule comprises a heavy chain comprising the amino acid sequence of SEQ ID NO: 808, or an amino acid sequence at least 85%, 90%, 95%, or 99% identical or higher to SEQ ID NO: 808. In one embodiment, the anti-TIM-3 antibody molecule comprises a light chain comprising the amino acid sequence of SEQ ID NO: 818, or an amino acid sequence at least 85%, 90%, 95%, or 99% identical or higher to SEQ ID NO: 818. In one embodiment, the anti-TIM-3 antibody molecule comprises a heavy chain comprising the amino acid sequence of SEQ ID NO: 824, or an amino acid sequence at least 85%, 90%, 95%, or 99% identical or higher to SEQ ID NO: 824. In one embodiment, the anti-TIM-3 antibody molecule comprises a light chain comprising the amino acid sequence of SEQ ID NO: 828, or an amino acid sequence at least 85%, 90%, 95%, or 99% identical or higher to SEQ ID NO: 828. In one embodiment, the anti-TIM-3 antibody molecule comprises a heavy chain comprising the amino acid sequence of SEQ ID NO: 808 and a light chain comprising the amino acid sequence of SEQ ID NO: 818. In one embodiment, the anti-TIM-3 antibody molecule comprises a heavy chain comprising the amino acid sequence of SEQ ID NO: 824 and a light chain comprising the amino acid sequence of SEQ ID NO: 828.

In one embodiment, the antibody molecule comprises a heavy chain encoded by the nucleotide sequence of SEQ ID NO: 809, or a nucleotide sequence at least 85%, 90%, 95%, or 99% identical or higher to SEQ ID NO: 809. In one embodiment, the antibody molecule comprises a light chain encoded by the nucleotide sequence of SEQ ID NO: 819, or a nucleotide sequence at least 85%, 90%, 95%, or 99% identical or higher to SEQ ID NO: 819. In one embodiment, the antibody molecule comprises a heavy chain encoded by the nucleotide sequence of SEQ ID NO: 825, or a nucleotide sequence at least 85%, 90%, 95%, or 99% identical or higher to SEQ ID NO: 825. In one embodiment, the antibody molecule comprises a light chain encoded by the nucleotide sequence of SEQ ID NO: 829, or a nucleotide sequence at least 85%, 90%, 95%, or 99% identical or higher to SEQ ID NO: 829. In one embodiment, the antibody molecule comprises a heavy chain encoded by the nucleotide sequence of SEQ ID NO: 809 and a light chain encoded by the nucleotide sequence of SEQ ID NO: 819. In one embodiment, the antibody molecule comprises a heavy chain encoded by the nucleotide sequence of SEQ ID NO: 825 and a light chain encoded by the nucleotide sequence of SEQ ID NO: 829.

The antibody molecules described herein can be made by vectors, host cells, and methods described in US 2015/0218274, incorporated by reference in its entirety.

TABLE 9

Amino acid and nucleotide sequences of exemplary anti-TIM-3 antibody molecules

ABTIM3-hum11

| | | |
|---|---|---|
| SEQ ID NO: 801 (Kabat) | HCDR1 | SYNMH |
| SEQ ID NO: 802 (Kabat) | HCDR2 | DIYPGNGDTSYNQKFKG |
| SEQ ID NO: 803 (Kabat) | HCDR3 | VGGAFPMDY |

TABLE 9-continued

Amino acid and nucleotide sequences of exemplary anti-TIM-3 antibody molecules

| SEQ ID NO: 804 (Chothia) | HCDR1 | GYTFTSY |
|---|---|---|
| SEQ ID NO: 805 (Chothia) | HCDR2 | YPGNGD |
| SEQ ID NO: 803 (Chothia) | HCDR3 | VGGAFPMDY |
| SEQ ID NO: 806 | VH | QVQLVQSGAEVKKPGSSVKVSCKASGYTFTSYNMHWVRQAPG QGLEWMGDIYPGNGDTSYNQKFKGRVTITADKSTSTVYMELSS LRSEDTAVYYCARVGGAFPMDYWGQGTTVTVSS |
| SEQ ID NO: 807 | DNA VH | CAGGTGCAGCTGGTGCAGTCAGGCGCCGAAGTGAAGAAACC CGGCTCTAGCGTGAAAGTTTCTTGTAAAGCTAGTGGCTACAC CTTCACTAGCTATAATATGCACTGGGTTCGCCAGGCCCCAGG GCAAGGCCTCGAGTGGATGGGCGATATCTACCCCGGGAACGG CGACACTAGTTATAATCAGAAGTTTAAGGGTAGAGTCACTAT CACCGCCGATAAGTCTACTAGCACCGTCTATATGGAACTGAG TTCCCTGAGGTCTGAGGACACCGCCGTCTACTACTGCGCTAG AGTGGGCGGAGCCTTCCCTATGGACTACTGGGGTCAAGGCAC TACCGTGACCGTGTCTAGC |
| SEQ ID NO: 808 | Heavy chain | QVQLVQSGAEVKKPGSSVKVSCKASGYTFTSYNMHWVRQAPG QGLEWMGDIYPGNGDTSYNQKFKGRVTITADKSTSTVYMELSS LRSEDTAVYYCARVGGAFPMDYWGQGTTVTVSSASTKGPSVFP LAPCSRSTSESTAALGCLVKDYFPEPVTVSWNSGALTSGVHTFP AVLQSSGLYSLSSVVTVPSSSLGTKTYTCNVDHKPSNTKVDKRV ESKYGPPCPPCPAPEFLGGPSVFLFPPKPKDTLMISRTPEVTCVVV DVSQEDPEVQFNWYVDGVEVHNAKTKPREEQFNSTYRVVSVLT VLHQDWLNGKEYKCKVSNKGLPSSIEKTISKAKGQPREPQVYTL PPSQEEMTKNQVSLTCLVKGFYPSDIAVEWESNGQPENNYKTTP PVLDSDGSFFLYSRLTVDKSRWQEGNVFSCSVMHEALHNHYTQ KSLSLSLG |
| SEQ ID NO: 809 | DNA heavy chain | CAGGTGCAGCTGGTGCAGTCAGGCGCCGAAGTGAAGAAACC CGGCTCTAGCGTGAAAGTTTCTTGTAAAGCTAGTGGCTACAC CTTCACTAGCTATAATATGCACTGGGTTCGCCAGGCCCCAGG GCAAGGCCTCGAGTGGATGGGCGATATCTACCCCGGGAACGG CGACACTAGTTATAATCAGAAGTTTAAGGGTAGAGTCACTAT CACCGCCGATAAGTCTACTAGCACCGTCTATATGGAACTGAG TTCCCTGAGGTCTGAGGACACCGCCGTCTACTACTGCGCTAG AGTGGGCGGAGCCTTCCCTATGGACTACTGGGGTCAAGGCAC TACCGTGACCGTGTCTAGCGCTAGCACTAAGGGCCCGTCCGT GTTCCCCCTGGCACCTTGTAGCCGGAGCACTAGCGAATCCAC CGCTGCCCTCGGCTGCCTGGTCAAGGATTACTTCCCGGAGCC CGTGACCGTGTCCTGGAACAGCGGAGCCCTGACCTCCGGAGT GCACACCTTCCCCGCTGTGCTGCAGAGCTCCGGGCTGTACTC GCTGTCGTCGGTGGTCACGGTGCCTTCATCTAGCCTGGGTACC AAGACCTACACTTGCAACGTGGACCACAAGCCTTCCAACACT AAGGTGGACAAGCGCGTCGAATCGAAGTACGGCCCACCGTG CCCGCCTTGTCCCGCGCCGGAGTTCCTCGGCGGTCCCTCGGTC TTTCTGTTCCCACCGAAGCCCAAGGACACTTTGATGATTTCCC GCACCCCTGAAGTGACATGCGTGGTCGTGGACGTGTCACAGG AAGATCCGGAGGTGCAGTTCAATTGGTACGTGGATGGCGTCG AGGTGCACAACGCCAAAACCAAGCCGAGGGAGGAGCAGTTC AACTCCACTTACCGCGTCGTGTCCGTGCTGACGGTGCTGCATC AGGACTGGCTGAACGGGAAGGAGTACAAGTGCAAAGTGTCC AACAAGGGACTTCCTAGCTCAATCGAAAAGACCATCTCGAAA GCCAAGGGACAGCCCCGGGAACCCCAAGTGTATACCCTGCCA CCCGAGCCAGGAAGAAATGACTAAGAACCAAGTCTCATTGACT TGCCTTGTGAAGGGCTTCTACCCATCGGATATCGCCGTGGAA TGGGAGTCCAACGGCCAGCCGGAAAACAACTACAAGACCAC CCCTCCGGTGCTGGACTCAGACGGATCCTTCTTCCTCTACTCG CGGCTGACCGTGGATAAGAGCAGATGGCAGGAGGGAAATGT GTTCAGCTGTTCTGTGATGCATGAAGCCCTGCACAACCACTA CACTCAGAAGTCCCTGTCCCTCTCCCTGGGA |
| SEQ ID NO: 810 (Kabat) | LCDR1 | RASESVEYYGTSLMQ |
| SEQ ID NO: 811 (Kabat) | LCDR2 | AASNVES |
| SEQ ID NO: 812 (Kabat) | LCDR3 | QQSRKDPST |
| SEQ ID NO: 813 (Chothia) | LCDR1 | SESVEYYGTSL |
| SEQ ID NO: 814 (Chothia) | LCDR2 | AAS |
| SEQ ID NO: 815 (Chothia) | LCDR3 | SRKDPS |

TABLE 9-continued

Amino acid and nucleotide sequences of exemplary anti-TIM-3 antibody molecules

| SEQ ID NO: 816 | VL | AIQLTQSPSSLSASVGDRVTITCRASESVEYYGTSLMQWYQQKP
GKAPKLLIYAASNVESGVPSRFSGSGSGTDFTLTISSLQPEDFATY
FCQQSRKDPSTFGGGTKVEIK |
|---|---|---|
| SEQ ID NO: 817 | DNA VL | GCTATTCAGCTGACTCAGTCACCTAGTAGCCTGAGCGCTAGT
GTGGGCGATAGAGTGACTATCACCTGTAGAGCTAGTGAATCA
GTCGAGTACTACGGCACTAGCCTGATGCAGTGGTATCAGCAG
AAGCCCGGGAAAGCCCCTAAGCTGCTGATCTACGCCGCCTCT
AACGTGGAATCAGGCGTGCCCTCTAGGTTTAGCGGTAGCGGT
AGTGGCACCGACTTCACCCTGACTATCTCTAGCCTGCAGCCC
GAGGACTTCGCTACCTACTTCTGTCAGCAGTCTAGGAAGGAC
CCTAGCACCTTCGGCGGAGGCACTAAGGTCGAGATTAAG |
| SEQ ID NO: 818 | Light chain | AIQLTQSPSSLSASVGDRVTITCRASESVEYYGTSLMQWYQQKP
GKAPKLLIYAASNVESGVPSRFSGSGSGTDFTLTISSLQPEDFATY
FCQQSRKDPSTFGGGTKVEIKRTVAAPSVFIFPPSDEQLKSGTAS
VVCLLNNFYPREAKVQWKVDNALQSGNSQESVTEQDSKDSTYS
LSSTLTLSKADYEKHKVYACEVTHQGLSSPVTKSFNRGEC |
| SEQ ID NO: 819 | DNA light chain | GCTATTCAGCTGACTCAGTCACCTAGTAGCCTGAGCGCTAGT
GTGGGCGATAGAGTGACTATCACCTGTAGAGCTAGTGAATCA
GTCGAGTACTACGGCACTAGCCTGATGCAGTGGTATCAGCAG
AAGCCCGGGAAAGCCCCTAAGCTGCTGATCTACGCCGCCTCT
AACGTGGAATCAGGCGTGCCCTCTAGGTTTAGCGGTAGCGGT
AGTGGCACCGACTTCACCCTGACTATCTCTAGCCTGCAGCCC
GAGGACTTCGCTACCTACTTCTGTCAGCAGTCTAGGAAGGAC
CCTAGCACCTTCGGCGGAGGCACTAAGGTCGAGATTAAGCGT
ACGGTGGCCGCTCCCAGCGTGTTCATCTTCCCCCCCAGCGAC
GAGCAGCTGAAGAGCGGCACCGCCAGCGTGGTGTGCCTGCTG
AACAACTTCTACCCCCGGGAGGCCAAGGTGCAGTGGAAGGTG
GACAACGCCCTGCAGAGCGGCAACAGCCAGGAGAGCGTCAC
CGAGCAGGACAGCAAGGACTCCACCTACAGCCTGAGCAGCA
CCCTGACCCTGAGCAAGGCCGACTACGAGAAGCATAAGGTGT
ACGCCTGCGAGGTGACCCACCAGGGCCTGTCCAGCCCCGTGA
CCAAGAGCTTCAACAGGGGCGAGTGC |

ABTIM3-hum03

| SEQ ID NO: 801 (Kabat) | HCDR1 | SYNMH |
|---|---|---|
| SEQ ID NO: 820 (Kabat) | HCDR2 | DIYPGQGDTSYNQKFKG |
| SEQ ID NO: 803 (Kabat) | HCDR3 | VGGAFPMDY |
| SEQ ID NO: 804 (Chothia) | HCDR1 | GYTFTSY |
| SEQ ID NO: 821 (Chothia) | HCDR2 | YPGQGD |
| SEQ ID NO: 803 (Chothia) | HCDR3 | VGGAFPMDY |
| SEQ ID NO: 822 | VH | QVQLVQSGAEVKKPGASVKVSCKASGYTFTSYNMHWVRQAPG
QGLEWIGDIYPGQGDTSYNQKFKGRATMTADKSTSTVYMELSS
LRSEDTAVYYCARVGGAFPMDYWGQGTLVTVSS |
| SEQ ID NO: 823 | DNA VH | CAGGTGCAGCTGGTGCAGTCAGGCGCCGAAGTGAAGAAACC
CGGCGCTAGTGTGAAAGTTAGCTGTAAAGCTAGTGGCTATAC
TTTCACTTCTTATAATATGCACTGGGTCCGCCAGGCCCCAGGT
CAAGGCGCTCGAGTGGATCGGCGATATCTACCCCGGTCAAGGC
GACACTTCCTATAATCAGAAGTTTAAGGGTAGAGCTACTATG
ACCGCCGATAAGTCTACTTCTACCGTCTATATGGAACTGAGTT
CCCTGAGGTCTGAGGACACCGCCGTCTACTACTGCGCTAGAG
TGGGCGGAGCCTTCCCAATGGACTACTGGGGTCAAGGCACCC
TGGTCACCGTGTCTAGC |
| SEQ ID NO: 824 | Heavy chain | QVQLVQSGAEVKKPGASVKVSCKASGYTFTSYNMHWVRQAPG
QGLEWIGDIYPGQGDTSYNQKFKGRATMTADKSTSTVYMELSS
LRSEDTAVYYCARVGGAFPMDYWGQGTLVTVSSASTKGPSVFP
LAPCSRSTSESTAALGCLVKDYFPEPVTVSWNSGALTSGVHTFP
AVLQSSGLYSLSSVVTVPSSSLGTKTYTCNVDHKPSNTKVDKRV
ESKYGPPCPPCPAPEFLGGPSVFLFPPKPKDTLMISRTPEVTCVVV
DVSQEDPEVQFNWYVDGVEVHNAKTKPREEQFNSTYRVVSVLT
VLHQDWLNGKEYKCKVSNKGLPSSIEKTISKAKGQPREPQVYTL
PPSQEEMTKNQVSLTCLVKGFYPSDIAVEWESNGQPENNYKTTP
PVLDSDGSFFLYSRLTVDKSRWQEGNVFSCSVMHEALHNHYTQ
KSLSLSLG |

TABLE 9-continued

Amino acid and nucleotide sequences of exemplary anti-TIM-3 antibody molecules

| SEQ ID NO: 825 | DNA heavy chain | CAGGTGCAGCTGGTGCAGTCAGGCGCCGAAGTGAAGAAACC CGGCGCTAGTGTGAAAGTTAGCTGTAAAGCTAGTGGCTATAC TTTCACTTCTTATAATATGCACTGGGTCCGCCAGGCCCCAGGT CAAGGCCTCGAGTGGATCGGCGATATCTACCCCGGTCAAGGC GACACTTCCTATAATCAGAAGTTTAAGGGTAGAGCTACTATG ACCGCCGATAAGTCTACTTCTACCGTCTATATGGAACTGAGTT CCCTGAGGTCTGAGGACACCGCCGTCTACTACTGCGCTAGAG TGGGCGGAGCCTTCCCAATGGACTACTGGGGTCAAGGCACCC TGGTCACCGTGTCTAGCGCTAGCACTAAGGGCCCGTCCGTGT TCCCCCTGGCACCTTGTAGCCGGAGCACTAGCGAATCCACCG CTGCCCTCGGCTGCCTGGTCAAGGATTACTTCCCGGAGCCCGT GACCGTGTCCTGGAACAGCGGAGCCCTGACCTCCGGAGTGCA CACCTTCCCCGCTGTGCTGCAGAGCTCCGGGCTGTACTCGCTG TCGTCGGTGGTCACGGTGCCTTCATCTAGCCTGGGTACCAAG ACCTACACTTGCAACGTGGACCACAAGCCTTCCAACACTAAG GTGGACAAGCGCGTCGAATCGAAGTACGGCCCACCGTGCCCG CCCTTGTCCCGCGCCGGAGTTCCTCGGCGGTCCCTCGGTCTTTC TGTTCCCACCGAAGCCCAAGGACACTTTGATGATTTCCCGCA CCCCTGAAGTGACATGCGTGGTCGTGGACGTGTCACAGGAAG ATCCGGAGGTGCAGTTCAATTGGTACGTGGATGGCGTCGAGG TGCACAACGCCAAAACCAAGCCGAGGGAGGAGCAGTTCAAC TCCACTTACCGCGTCGTGTCCGTGCTGACGGTGCTGCATCAGG ACTGGCTGAACGGGAAGGAGTACAAGTGCAAAGTGTCCAAC AAGGGACTTCCTAGCTCAATCGAAAAGACCATCTCGAAAGCC AAGGGACAGCCCCGGGAACCCCAAGTGTATACCCTGCCACCG AGCCAGGAAGAAATGACTAAGAACCAAGTCTCATTGACTTGC CTTGTGAAGGGCTTCTACCCATCGGATATCGCCGTGGAATGG GAGTCCAACGGCCAGCCGGAAAACAACTACAAGACCACCCC TCCGGTGCTGGACTCAGACGGATCCTTCTTCCTCTACTCGCGG CTGACCGTGGATAAGAGCAGATGGCAGGAGGGAAATGTGTT CAGCTGTTCTGTGATGCATGAAGCCCTGCACAACCACTACAC TCAGAAGTCCCTGTCCCTCTCCCTGGGA |
| SEQ ID NO: 810 (Kabat) | LCDR1 | RASESVEYYGTSLMQ |
| SEQ ID NO: 811 (Kabat) | LCDR2 | AASNVES |
| SEQ ID NO: 812 (Kabat) | LCDR3 | QQSRKDPST |
| SEQ ID NO: 813 (Chothia) | LCDR1 | SESVEYYGTSL |
| SEQ ID NO: 814 (Chothia) | LCDR2 | AAS |
| SEQ ID NO: 815 (Chothia) | LCDR3 | SRKDPS |
| SEQ ID NO: 826 | VL | DIVLTQSPDSLAVSLGERATINCRASESVEYYGTSLMQWYQQKP GQPPKLLIYAASNVESGVPDRFSGSGSGTDFTLTISSLQAEDVAV YYCQQSRKDPSTFGGGTKVEIK |
| SEQ ID NO: 827 | DNA VL | GATATCGTCCTGACTCAGTCACCCGATAGCCTGGCCGTCAGC CTGGGCGAGCGGGCTACTATTAACTGTAGAGCTAGTGAATCA GTCGAGTACTACGGCACTAGCCTGATGCAGTGGTATCAGCAG AAGCCCGGTCAACCCCCTAAGCTGCTGATCTACGCCGCCTCT AACGTGGAATCAGGCGTGCCCGATAGGTTTAGCGGGTAGCGGT AGTGGCACCGACTTCACCCTGACTATTAGTAGCCTGCAGGCC GAGGACGTGGCCGTCTACTACTGTCAGCAGTCTAGGAAGGAC CCTAGCACCTTCGGCGGAGGCACTAAGGTCGAGATTAAG |
| SEQ ID NO: 828 | Light chain | DIVLTQSPDSLAVSLGERATINCRASESVEYYGTSLMQWYQQKP GQPPKLLIYAASNVESGVPDRFSGSGSGTDFTLTISSLQAEDVAV YYCQQSRKDPSTFGGGTKVEIKRTVAAPSVFIFPPSDEQLKSGTA SVVCLLNNFYPREAKVQWKVDNALQSGNSQESVTEQDSKDSTY SLSSTLTLSKADYEKHKVYACEVTHQGLSSPVTKSFNRGEC |
| SEQ ID NO: 829 | DNA light chain | GATATCGTCCTGACTCAGTCACCCGATAGCCTGGCCGTCAGC CTGGGCGAGCGGGCTACTATTAACTGTAGAGCTAGTGAATCA GTCGAGTACTACGGCACTAGCCTGATGCAGTGGTATCAGCAG AAGCCCGGTCAACCCCCTAAGCTGCTGATCTACGCCGCCTCT AACGTGGAATCAGGCGTGCCCGATAGGTTTAGCGGGTAGCGGT AGTGGCACCGACTTCACCCTGACTATTAGTAGCCTGCAGGCC GAGGACGTGGCCGTCTACTACTGTCAGCAGTCTAGGAAGGAC CCTAGCACCTTCGGCGGAGGCACTAAGGTCGAGATTAAGCGT ACGGTGGCCGCTCCCAGCGTGTTCATCTTCCCCCCCAGCGAC GAGCAGCTGAAGAGCGGCACCGCCAGCGTGGTGTGCCTGCTG AACAACTTCTACCCCGGGAGGCCAAGGTGCAGTGGAAGGTG GACAACGCCCTGCAGAGCGGCAACAGCCAGGAGAGCGTCAC CGAGCAGGACAGCAAGGACTCCACCTACAGCCTGAGCAGCA |

TABLE 9-continued

Amino acid and nucleotide sequences of exemplary anti-TIM-3 antibody molecules

CCCTGACCCTGAGCAAGGCCGACTACGAGAAGCATAAGGTGT
ACGCCTGCGAGGTGACCCACCAGGGCCTGTCCAGCCCCGTGA
CCAAGAGCTTCAACAGGGGCGAGTGC

Other Exemplary TIM-3 Inhibitors

In one embodiment, the anti-TIM-3 antibody molecule is TSR-022 (AnaptysBio/Tesaro). In one embodiment, the anti-TIM-3 antibody molecule comprises one or more of the CDR sequences (or collectively all of the CDR sequences), the heavy chain or light chain variable region sequence, or the heavy chain or light chain sequence of TSR-022. In one embodiment, the anti-TIM-3 antibody molecule comprises one or more of the CDR sequences (or collectively all of the CDR sequences), the heavy chain or light chain variable region sequence, or the heavy chain or light chain sequence of APE5137 or APE5121, e.g., as disclosed in Table 10. APE5137, APE5121, and other anti-TIM-3 antibodies are disclosed in WO 2016/161270, incorporated by reference in its entirety.

In one embodiment, the anti-TIM-3 antibody molecule is LY3321367 (Eli Lilly). In one embodiment, the anti-TIM-3 antibody molecule comprises one or more of the CDR sequences (or collectively all of the CDR sequences), the heavy chain or light chain variable region sequence, or the heavy chain or light chain sequence of LY3321367.

In one embodiment, the anti-TIM-3 antibody molecule is the antibody clone F38-2E2. In one embodiment, the anti-TIM-3 antibody molecule comprises one or more of the CDR sequences (or collectively all of the CDR sequences), the heavy chain or light chain variable region sequence, or the heavy chain or light chain sequence of F38-2E2.

Further known anti-TIM-3 antibodies include those described, e.g., in WO 2016/111947, WO 2016/071448, WO 2016/144803, U.S. Pat. Nos. 8,552,156, 8,841,418, and 9,163,087, incorporated by reference in their entirety.

In one embodiment, the anti-TIM-3 antibody is an antibody that competes for binding with, and/or binds to the same epitope on TIM-3 as, one of the anti-TIM-3 antibodies described herein.

TABLE 10

Amino acid sequences of other exemplary anti-TIM-3 antibody molecules

APE5137

| SEQ ID NO: 830 | VH | EVQLLESGGGLVQPGGSLRLSCAAASGFTFS<br>SYDMSWVRQAPGKGLDWVSTISGGGTYTYYQ<br>DSVKGRFTISRDNSKNTLYLQMNSLRAEDTA<br>VYYCASMDYWGQGTTVTVSSA |
|---|---|---|
| SEQ ID NO: 831 | VL | DIQMTQSPSSLSASVGDRVTITCRASQSIRR<br>YLNWYHQKPGKAPKLLIYGASTLQSGVPSRF<br>SGSGSGTDFTLTISSLQPEDFAVYYCQQSHS<br>APLTFGGGTKVEIKR |

APE5121

| SEQ ID NO: 832 | VH | EVQVLESGGGLVQPGGSLRLYCVASGFTFSG<br>SYAMSWVRQAPGKGLEWVSAISGSGGSTYYA<br>DSVKGRFTISRDNSKNTLYLQMNSLRAEDTA<br>VYYCAKKYYVGPADYWGQGTLVTVSSG |
|---|---|---|
| SEQ ID NO: 833 | VL | DIVMTQSPDSLAVSLGERATINCKSSQSVLY<br>SSNNKNYLAWYQHKPGQPPKLLIYWASTRES |

TABLE 10-continued

Amino acid sequences of other exemplary anti-TIM-3 antibody molecules

GVPDRFSGSGSGTDFTLTISSLQAEDVAVYY
CQQYYSSPLTFGGGTKIEVK

CTLA-4 Inhibitors

In certain embodiments, the anti-human ENTPD2 antibody molecule described herein is administered in combination with a CTLA-4 inhibitor. The CTLA-4 inhibitor may be an antibody, an antigen binding fragment thereof, an immunoadhesin, a fusion protein, or an oligopeptide. In some embodiments, the CTLA-4 inhibitor is Ipilimumab (Yervoy®, Bristol-Myers Squibb) or Tremelimumab (Pfizer). The antibody Ipilimumab and other anti-CTLA-4 antibodies are disclosed in U.S. Pat. No. 6,984,720, herein incorporated by reference. The antibody Tremelimumab and other anti-CTLA-4 antibodies are disclosed in U.S. Pat. No. 7,411,057, herein incorporated by reference.

GITR Agonists

In certain embodiments, the anti-human ENTPD2 antibody as described herein is administered in combination with a GITR agonist. The GITR agonist may be an antibody, an antigen binding fragment thereof, an immunoadhesin, a fusion protein, or an oligopeptide. In some embodiments, the GITR agonist is GWN323 (Novartis), BMS-986156 (BMS), MK-4166 or MK-1248 (Merck), TRX518 (Leap Therapeutics), INCAGN1876 (Incyte/Agenus), AMG 228 (Amgen) or INBRX-110 (Inhibrx).

Exemplary Anti-GITR Antibody Molecules

In one embodiment, the GITR agonist is an anti-GITR antibody molecule. In one embodiment, the GITR agonist is an anti-GITR antibody molecule as described in WO 2016/057846, published on Apr. 14, 2016, entitled "Compositions and Methods of Use for Augmented Immune Response and Cancer Therapy," incorporated by reference in its entirety.

In one embodiment, the anti-GITR antibody molecule comprises at least one, two, three, four, five or six complementarity determining regions (CDRs) (or collectively all of the CDRs) from a heavy and light chain variable region comprising an amino acid sequence shown in Table 11 (e.g., from the heavy and light chain variable region sequences of MAB7 disclosed in Table 11), or encoded by a nucleotide sequence shown in Table 11. In some embodiments, the CDRs are according to the Kabat definition (e.g., as set out in Table 11). In some embodiments, the CDRs are according to the Chothia definition (e.g., as set out in Table 11). In one embodiment, one or more of the CDRs (or collectively all of the CDRs) have one, two, three, four, five, six or more changes, e.g., amino acid substitutions (e.g., conservative amino acid substitutions) or deletions, relative to an amino acid sequence shown in Table 11, or encoded by a nucleotide sequence shown in Table 11.

In one embodiment, the anti-GITR antibody molecule comprises a heavy chain variable region (VH) comprising a VHCDR1 amino acid sequence of SEQ ID NO: 909, a VHCDR2 amino acid sequence of SEQ ID NO: 911, and a VHCDR3 amino acid sequence of SEQ ID NO: 913; and a light chain variable region (VL) comprising a VLCDR1 amino acid sequence of SEQ ID NO: 914, a VLCDR2 amino acid sequence of SEQ ID NO: 916, and a VLCDR3 amino acid sequence of SEQ ID NO: 918, each disclosed in Table 11.

In one embodiment, the anti-GITR antibody molecule comprises a VH comprising the amino acid sequence of SEQ ID NO: 901, or an amino acid sequence at least 85%, 90%, 95%, or 99% identical or higher to SEQ ID NO: 901. In one embodiment, the anti-GITR antibody molecule comprises a VL comprising the amino acid sequence of SEQ ID NO: 902, or an amino acid sequence at least 85%, 90%, 95%, or 99% identical or higher to SEQ ID NO: 902. In one embodiment, the anti-GITR antibody molecule comprises a VH comprising the amino acid sequence of SEQ ID NO: 901 and a VL comprising the amino acid sequence of SEQ ID NO: 902.

In one embodiment, the antibody molecule comprises a VH encoded by the nucleotide sequence of SEQ ID NO: 905, or a nucleotide sequence at least 85%, 90%, 95%, or 99% identical or higher to SEQ ID NO: 905. In one embodiment, the antibody molecule comprises a VL encoded by the nucleotide sequence of SEQ ID NO: 906, or a nucleotide sequence at least 85%, 90%, 95%, or 99% identical or higher to SEQ ID NO: 906. In one embodiment, the antibody molecule comprises a VH encoded by the nucleotide sequence of SEQ ID NO: 905 and a VL encoded by the nucleotide sequence of SEQ ID NO: 906.

In one embodiment, the anti-GITR antibody molecule comprises a heavy chain comprising the amino acid sequence of SEQ ID NO: 903, or an amino acid sequence at least 85%, 90%, 95%, or 99% identical or higher to SEQ ID NO: 903. In one embodiment, the anti-GITR antibody molecule comprises a light chain comprising the amino acid sequence of SEQ ID NO: 904, or an amino acid sequence at least 85%, 90%, 95%, or 99% identical or higher to SEQ ID NO: 904. In one embodiment, the anti-GITR antibody molecule comprises a heavy chain comprising the amino acid sequence of SEQ ID NO: 903 and a light chain comprising the amino acid sequence of SEQ ID NO: 904.

In one embodiment, the antibody molecule comprises a heavy chain encoded by the nucleotide sequence of SEQ ID NO: 907, or a nucleotide sequence at least 85%, 90%, 95%, or 99% identical or higher to SEQ ID NO: 907. In one embodiment, the antibody molecule comprises a light chain encoded by the nucleotide sequence of SEQ ID NO: 908, or a nucleotide sequence at least 85%, 90%, 95%, or 99% identical or higher to SEQ ID NO: 908. In one embodiment, the antibody molecule comprises a heavy chain encoded by the nucleotide sequence of SEQ ID NO: 907 and a light chain encoded by the nucleotide sequence of SEQ ID NO: 908.

The antibody molecules described herein can be made by vectors, host cells, and methods described in WO 2016/057846, incorporated by reference in its entirety.

TABLE 11

Amino acid and nucleotide sequences of exemplary anti-GITR antibody molecule

| MAB7 | | |
|---|---|---|
| SEQ ID NO: 901 | VH | EVQLVESGGGLVQSGGSLRLSCAASGFSLSSYGVDWVRQAP GKGLEWVGVIWGGGTYYASSLMGRFTISRDNSKNTLYLQ MNSLRAEDTAVYYCARHAYGHDGGFAMDYWGQGTLVTVS S |
| SEQ ID NO: 902 | VL | EIVMTQSPATLSVSPGERATLSCRASESVSSNVAWYQQRPGQ APRLLIYGASNRATGIPARFSGSGSGTDFTLTISRLEPEDFAVY YCGQSYSYPFTFGQGTKLEIK |
| SEQ ID NO: 903 | Heavy Chain | EVQLVESGGGLVQSGGSLRLSCAASGFSLSSYGVDWVRQAP GKGLEWVGVIWGGGTYYASSLMGRFTISRDNSKNTLYLQ MNSLRAEDTAVYYCARHAYGHDGGFAMDYWGQGTLVTVS SASTKGPSVFPLAPSSKSTSGGTAALGCLVKDYFPEPVTVSW NSGALTSGVHTFPAVLQSSGLYSLSSVVTVPSSSLGTQTYICN VNHKPSNTKVDKRVEPKSCDKTHTCPPCPAPELLGGPSVFLF PPKPKDTLMISRTPEVTCVVVDVSHEDPEVKFNWYVDGVEV HNAKTKPREEQYNSTYRVVSVLTVLHQDWLNGKEYKCKVS NKALPAPIEKTISKAKGQPREPQVYTLPPSREEMTKNQVSLTC LVKGFYPSDIAVEWESNGQPENNYKTTPPVLDSDGSFFLYSK LTVDKSRWQQGNVFSCSVMHEALHNHYTQKSLSLSPGK |
| SEQ ID NO: 904 | Light Chain | EIVMTQSPATLSVSPGERATLSCRASESVSSNVAWYQQRPGQ APRLLIYGASNRATGIPARFSGSGSGTDFTLTISRLEPEDFAVY YCGQSYSYPFTFGQGTKLEIKRTVAAPSVFIFPPSDEQLKSGT ASVVCLLNNFYPREAKVQWKVDNALQSGNSQESVTEQDSK DSTYSLSSTLTLSKADYEKHKVYACEVTHQGLSSPVTKSFNR GEC |
| SEQ ID NO: 905 | DNA VH | GAGGTGCAGCTGGTGGAATCTGGCGGCGGACTGGTGCAG TCCGGCGGCTCTCTGAGACTGTCTTGCGCTGCCTCCGGCTT CTCCCTGTCCTCTTACGGCGTGGACTGGGTGCGACAGGCC CCTGGCAAGGGCCTGGAATGGGTGGGAGTGATCTGGGGC GGAGGCGGCACCTACTACGCCTCTTCCCTGATGGGCCGGT TCACCATCTCCCGGGACAACTCCAAGAACACCCTGTACCT GCAGATGAACTCCCTGCGGGCCGAGGACACCGCCGTGTAC TACTGCGCCAGACACGCCTACGGCCACGACGGCGGCTTCG CCATGGATTATTGGGGCCAGGGCACCCTGGTGACAGTGTC CTCC |

TABLE 11-continued

Amino acid and nucleotide sequences of exemplary anti-GITR antibody molecule

| SEQ ID NO: 906 | DNA VL | GAGATCGTGATGACCCAGTCCCCCGCCACCCTGTCTGTGT
CTCCCGGCGAGAGAGCCACCCTGAGCTGCAGAGCCTCCGA
GTCCGTGTCCTCCAACGTGGCCTGGTATCAGCAGAGACCT
GGTCAGGCCCCTCGGCTGCTGATCTACGGCGCCTCTAACC
GGGCCACCGGCATCCCTGCCAGATTCTCCGGCTCCGGCAG
CGGCACCGACTTCACCCTGACCATCTCCCGGCTGGAACCC
GAGGACTTCGCCGTGTACTACTGCGGCCAGTCCTACTCAT
ACCCCTTCACCTTCGGCCAGGGCACCAAGCTGGAAATCAA
G |
| SEQ ID NO: 907 | DNA Heavy Chain | GAGGTGCAGCTGGTGGAATCTGGCGGCGGACTGGTGCAG
TCCGGCGGCTCTCTGAGACTGTCTTGCGCTGCCTCCGGCTT
CTCCCTGTCCTCTTACGGCGTGGACTGGGTGCGACAGGCC
CCTGGCAAGGGCCTGGAATGGGTGGGAGTGATCTGGGGC
GGAGGCGGCACCTACTACGCCTCTTCCCTGATGGGCCGGT
TCACCATCTCCCGGGACAACTCCAAGAACACCCTGTACCT
GCAGATGAACTCCCTGCGGGCCGAGGACACCGCCGTGTAC
TACTGCGCCAGACACGCCTACGGCCACGACGGCGGCTTCG
CCATGGATTATTGGGGCCAGGGCACCCTGGTGACAGTGTC
CTCCGCTAGCACCAAGGGCCCAAGTGTGTTTCCCCTGGCC
CCCAGCAGCAAGTCTACTTCCGGCGGAACTGCTGCCCTGG
GTTGCCTGGTGAAGGACTACTTCCCCGAGCCCGTGACAGT
GTCCTGGAACTCTGGGGCTCTGACTTCCGGCGTGCACACC
TTCCCCGCCGTGCTGCAGAGCAGCGGCCTGTACAGCCTGA
GCAGCGTGGTGACAGTGCCCTCCAGCTCTCTGGGAACCCA
GACCTATATCTGCAACGTGAACCACAAGCCCAGCAACACC
AAGGTGGACAAGAGAGTGGAGCCCAAGAGCTGCGACAAG
ACCCACACCTGCCCCCCTGCCCAGCTCCAGAACTGCTGG
GAGGGCCTTCCGTGTTCCTGTTCCCCCCCAAGCCCAAGGA
CACCCTGATGATCAGCAGGACCCCCGAGGTGACCTGCGTG
GTGGTGGACGTGTCCCACGAGGACCCAGAGGTGAAGTTC
AACTGGTACGTGGACGGCGTGGAGGTGCACAACGCCAAG
ACCAAGCCCAGAGAGGAGCAGTACAACAGCACCTACAGG
GTGGTGTCCGTGCTGACCGTGCTGCACCAGGACTGGCTGA
ACGGCAAAGAATACAAGTGCAAAGTCTCCAACAAGGCCC
TGCCAGCCCCAATCGAAAAGACAATCAGCAAGGCCAAGG
GCCAGCCACGGGAGCCCCAGGTGTACACCCTGCCCCCCAG
CCGGGAGGAGATGACCAAGAACCAGGTGTCCCTGACCTG
TCTGGTGAAGGGCTTCTACCCCAGCGATATCGCCGTGGAG
TGGGAGAGCAACGGCCAGCCCGAGAACAACTACAAGACC
ACCCCCCCAGTGCTGGACAGCGACGGCAGCTTCTTCCTGT
ACAGCAAGCTGACCGTGGACAAGTCCAGGTGGCAGCAGG
GCAACGTGTTCAGCTGCAGCGTGATGCACGAGGCCCTGCA
CAACCACTACACCCAGAAGTCCCTGAGCCTGAGCCCCGGC
AAG |
| SEQ ID NO: 908 | DNA Light Chain | GAGATCGTGATGACCCAGTCCCCCGCCACCCTGTCTGTGT
CTCCCGGCGAGAGAGCCACCCTGAGCTGCAGAGCCTCCGA
GTCCGTGTCCTCCAACGTGGCCTGGTATCAGCAGAGACCT
GGTCAGGCCCCTCGGCTGCTGATCTACGGCGCCTCTAACC
GGGCCACCGGCATCCCTGCCAGATTCTCCGGCTCCGGCAG
CGGCACCGACTTCACCCTGACCATCTCCCGGCTGGAACCC
GAGGACTTCGCCGTGTACTACTGCGGCCAGTCCTACTCAT
ACCCCTTCACCTTCGGCCAGGGCACCAAGCTGGAAATCAA
GCGTACGGTGGCCGCTCCCAGCGTGTTCATCTTCCCCCCC
AGCGACGAGCAGCTGAAGAGCGGCACCGCCAGCGTGGTG
TGCCTGCTGAACAACTTCTACCCCCGGGAGGCCAAGGTGC
AGTGGAAGGTGGACAACGCCCTGCAGAGCGGCAACAGCC
AGGAGAGCGTCACCGAGCAGGACAGCAAGGACTCCACCT
ACAGCCTGAGCAGCACCCTGACCCTGAGCAAGGCCGACT
ACGAGAAGCATAAGGTGTACGCCTGCGAGGTGACCCACC
AGGGCCTGTCCAGCCCCGTGACCAAGAGCTTCAACAGGG
GCGAGTGC |
| SEQ ID NO: 909 (KABAT) | HCDR1 | SYGVD |
| SEQ ID NO: 910 (CHOTHIA) | HCDR1 | GFSLSSY |
| SEQ ID NO: 911 (KABAT) | HCDR2 | VIWGGGGTYYASSLMG |
| SEQ ID NO: 912 (CHOTHIA) | HCDR2 | WGGGG |
| SEQ ID NO: 913 (KABAT) | HCDR3 | HAYGHDGGFAMDY |
| SEQ ID NO: 913 (CHOTHIA) | HCDR3 | HAYGHDGGFAMDY |

TABLE 11-continued

Amino acid and nucleotide sequences of exemplary anti-GITR antibody molecule

| | | | |
|---|---|---|---|
| SEQ ID NO: 914 | (KABAT) | LCDR1 | RASESVSSNVA |
| SEQ ID NO: 915 | (CHOTHIA) | LCDR1 | SESVSSN |
| SEQ ID NO: 916 | (KABAT) | LCDR2 | GASNRAT |
| SEQ ID NO: 917 | (CHOTHIA) | LCDR2 | GAS |
| SEQ ID NO: 918 | (KABAT) | LCDR3 | GQSYSYPFT |
| SEQ ID NO: 919 | (CHOTHIA) | LCDR3 | SYSYPF |

Other Exemplary Anti-GITR Antibodies and Agonists

In one embodiment, the anti-GITR antibody molecule is BMS-986156 (Bristol-Myers Squibb), also known as BMS 986156 or BMS986156. BMS-986156 and other anti-GITR antibodies are disclosed, e.g., in U.S. Pat. No. 9,228,016 and WO 2016/196792, incorporated by reference in their entirety. In one embodiment, the anti-GITR antibody molecule comprises one or more of the CDR sequences (or collectively all of the CDR sequences), the heavy chain or light chain variable region sequence, or the heavy chain or light chain sequence of BMS-986156, e.g., as disclosed in Table 12.

In one embodiment, the anti-GITR antibody molecule is MK-4166 or MK-1248 (Merck). MK-4166, MK-1248, and other anti-GITR antibodies are disclosed, e.g., in U.S. Pat. No. 8,709,424, WO 2011/028683, WO 2015/026684, and Mahne et al. *Cancer Res.* 2017; 77(5):1108-1118, incorporated by reference in their entirety. In one embodiment, the anti-GITR antibody molecule comprises one or more of the CDR sequences (or collectively all of the CDR sequences), the heavy chain or light chain variable region sequence, or the heavy chain or light chain sequence of MK-4166 or MK-1248.

In one embodiment, the anti-GITR antibody molecule is TRX518 (Leap Therapeutics). TRX518 and other anti-GITR antibodies are disclosed, e.g., in U.S. Pat. Nos. 7,812,135, 8,388,967, 9,028,823, WO 2006/105021, and Ponte J et al. (2010) *Clinical Immunology;* 135:S96, incorporated by reference in their entirety. In one embodiment, the anti-GITR antibody molecule comprises one or more of the CDR sequences (or collectively all of the CDR sequences), the heavy chain or light chain variable region sequence, or the heavy chain or light chain sequence of TRX518.

In one embodiment, the anti-GITR antibody molecule is INCAGN1876 (Incyte/Agenus). INCAGN1876 and other anti-GITR antibodies are disclosed, e.g., in US 2015/0368349 and WO 2015/184099, incorporated by reference in their entirety. In one embodiment, the anti-GITR antibody molecule comprises one or more of the CDR sequences (or collectively all of the CDR sequences), the heavy chain or light chain variable region sequence, or the heavy chain or light chain sequence of INCAGN1876.

In one embodiment, the anti-GITR antibody molecule is AMG 228 (Amgen). AMG 228 and other anti-GITR antibodies are disclosed, e.g., in U.S. Pat. No. 9,464,139 and WO 2015/031667, incorporated by reference in their entirety. In one embodiment, the anti-GITR antibody molecule comprises one or more of the CDR sequences (or collectively all of the CDR sequences), the heavy chain or light chain variable region sequence, or the heavy chain or light chain sequence of AMG 228.

In one embodiment, the anti-GITR antibody molecule is INBRX-110 (Inhibrx). INBRX-110 and other anti-GITR antibodies are disclosed, e.g., in US 2017/0022284 and WO 2017/015623, incorporated by reference in their entirety. In one embodiment, the GITR agonist comprises one or more of the CDR sequences (or collectively all of the CDR sequences), the heavy chain or light chain variable region sequence, or the heavy chain or light chain sequence of INBRX-110.

In one embodiment, the GITR agonist (e.g., a fusion protein) is MEDI 1873 (MedImmune), also known as MEDI1873. MEDI 1873 and other GITR agonists are disclosed, e.g., in US 2017/0073386, WO 2017/025610, and Ross et al. *Cancer Res* 2016; 76(14 Suppl): Abstract nr 561, incorporated by reference in their entirety. In one embodiment, the GITR agonist comprises one or more of an IgG Fc domain, a functional multimerization domain, and a receptor binding domain of a glucocorticoid-induced TNF receptor ligand (GITRL) of MEDI 1873.

Further known GITR agonists (e.g., anti-GITR antibodies) include those described, e.g., in WO 2016/054638, incorporated by reference in its entirety.

In one embodiment, the anti-GITR antibody is an antibody that competes for binding with, and/or binds to the same epitope on GITR as, one of the anti-GITR antibodies described herein.

In one embodiment, the GITR agonist is a peptide that activates the GITR signaling pathway. In one embodiment, the GITR agonist is an immunoadhesin binding fragment (e.g., an immunoadhesin binding fragment comprising an extracellular or GITR binding portion of GITRL) fused to a constant region (e.g., an Fc region of an immunoglobulin sequence).

TABLE 12

Amino acid sequences of other exemplary anti-GITR antibody molecules

BMS-986156

| | | |
|---|---|---|
| SEQ ID NO: 920 | VH | QVQLVESGGGVVQPGRSLRLSCAASGFTFSS YGMHWVRQAPGKGLEWVAVIWYEGSNKYYAD SVKGRFTISRDNSKNTLYLQMNSLRAEDTAV YYCARGGSMVRGDYYYGMDVWGQGTTVTVSS |
| SEQ ID NO: 921 | VL | AIQLTQSPSSLSASVGDRVTITCRASQGISS ALAWYQQKPGKAPKLLIYDASSLESGVPSRF SGSGSGTDFTLTISSLQPEDFATYYCQQFNS YPYTFGQGTKLEIK |

Exemplary Anti-CD3 Multispecific Antibody Molecules

In certain embodiments, the anti-human ENTPD2 antibody molecule described herein is administered in combination with an anti-CD3 multispecific antibody molecule (e.g., an anti-CD3 bispecific antibody molecule). In one embodiment, the anti-CD3 multispecific antibody molecule binds to CD3 and a target tumor antigen (TTA). In one embodiment, the TTA is chosen from CD19, CD20, CD38, or CD123. In one embodiment, the anti-CD3 multispecific antibody molecule is in a format disclosed in FIGS. 1A, 1B, 1C, and 125 of WO 2016/182751, herein incorporated by reference in its entirety.

In one embodiment, the anti-CD3 multispecific antibody molecule is an anti-CD3×anti-CD123 bispecific antibody molecule, e.g., XENP14045 (e.g., as set out in Table 15) or an anti-CD3×anti-CD123 bispecific antibody molecule disclosed in WO 2016/086189 or WO 2016/182751, herein incorporated by reference in their entirety. In one embodiment, the anti-CD3×anti-CD123 bispecific antibody molecule comprises one or more of the CDR sequences (or collectively all of the CDR sequences), the heavy chain or light chain variable region sequence, or the heavy chain or light chain sequence of XENP14045, or an amino acid sequence substantially identical thereto (e.g., a sequence having at least about 85%, 90%, or 95% sequence identity thereto).

In one embodiment, the anti-CD3 multispecific antibody is an anti-CD3×anti-CD20 bispecific antibody molecule, e.g., XENP13676 (e.g., as set out in Table 13) or an anti-CD3×anti-CD20 bispecific antibody molecule disclosed in WO 2016/086189 or WO 2016/182751, herein incorporated by reference in their entirety. In one embodiment, the anti-CD3×anti-CD20 bispecific antibody molecule comprises one or more of the CDR sequences (or collectively all of the CDR sequences), the heavy chain or light chain variable region sequence, or the heavy chain or light chain sequence of XENP13676, or an amino acid sequence substantially identical thereto (e.g., a sequence having at least about 85%, 90%, or 95% sequence identity thereto).

TABLE 13

Amino acid sequences of exemplary anti-CD3 bispecific antibody molecules

XENP14045 (anti-CD123 x anti-CD3 Fab-scFv-Fc)

| | | |
|---|---|---|
| SEQ ID NO: 314 | Heavy chain 1 (anti-CD 123 Fab-Fc) | QVQLQQSGAEVKKPGASVKVSCKASGYTFTDYYMKWVKQSHGKS LEWMGDIIPSNGATFYNQKFKGKATLTVDRSTSTAYMELSSLRSED TAVYYCARSHLLRASWFAYWGQGTLVTVSSASTKGPSVFPLAPSSK STSGGTAALGCLVKDYFPEPVTVSWNSGALTSGVHTFPAVLQSSGL YSLSSVVTVPSSSLGTQTYICNVNHKPSDTKVDKKVEPKSCDKTHT CPPCPAPPVAGPSVFLFPPKPKDTLMISRTPEVTCVVVDVKHEDPEV KFNWYVDGVEVHNAKTKPREEEYNSTYRVVSVLTVLHQDWLNGK EYKCKVSNKALPAPIEKTISKAKGQPREPQVYTLPPSREEMTKNQVS LTCDVSGFYPSDIAVEWESDGQPENNYKTTPPVLDSDGSFFLYSKLT VDKSRWEQGDVFSCSVMHEALHNHYTQKSLSLSPGK |
| SEQ ID NO: 315 | Heavy chain 2 (anti-CD3 scFv-Fc) | EVQLVESGGGLVQPGGSLRLSCAASGFTFSTYAMNWVRQAPGKGL EWVGRIRSKYNNYATYYADSVKGRFTISRDDSKNTLYLQMNSLRA EDTAVYYCVRHGNFGDSYVSWFAYWGQGTLVTVSSGKPGSGKPG SGKPGSGKPGSQAVVTQEPSLTVSPGGTVTLTCGSSTGAVTTSNYA NWVQQKPGKSPRGLIGGTNKRAPGVPARFSGSLLGGKAALTISGAQ PEDEADYYCALWYSNHWVFGGGTKLTVLEPKSSDKTHTCPPCPAP PVAGPSVFLFPPKPKDTLMISRTPEVTCVVVDVKHEDPEVKFNWYV DGVEVHNAKTKPREEQYNSTYRVVSVLTVLHQDWLNGKEYKCKV SNKALPAPIEKTISKAKGQPREPQVYTLPPSREQMTKNQVKLTCLVK GFYPSDIAVEWESNGQPENNYKTTPPVLDSDGSFFLYSKLTVDKSR WQQGNVFSCSVMHEALHNHYTQKSLSLSPGK |
| SEQ ID NO: 316 | Light chain | DFVMTQSPDSLAVSLGERATINCKSSQSLLNTGNQKNYLTWYQQKP GQPPKLLIYWASTRESGVPDRFTGSGSGTDFTLTISSLQAEDVAVYY CQNDYSYPYTFGGGTKLEIKRTVAAPSVFIFPPSDEQLKSGTASVVC LLNNFYPREAKVQWKVDNALQSGNSQESVTEQDSKDSTYSLSSTLT LSKADYEKHKVYACEVTHQGLSSPVTKSFNRGEC |

XENP13676 (anti-CD20 x anti-CD3 Fab-scFv-Fc)

| | | |
|---|---|---|
| SEQ ID NO: 317 | Heavy chain 1 (Fab-Fc) | QVQLVQSGAEVKKPGASVKVSCKASGYTFTSYNMHWVRQAPGQG LEWMGAIYPGNGDTSYNQKFQGRVTITADKSISTAYMELSSLRSED TAVYYCARSTYYGGDWYFNVWGAGTLVTVSSASTKGPSVFPLAPS SKSTSGGTAALGCLVKDYFPEPVTVSWNSGALTSGVHTFPAVLQSS GLYSLSSVVTVPSSSLGTQTYICNVNHKPSDTKVDKKVEPKSCDKT HTCPPCPAPPVAGPSVFLFPPKPKDTLMISRTPEVTCVVVDVKHEDP EVKFNWYVDGVEVHNAKTKPREEEYNSTYRVVSVLTVLHQDWLN GKEYKCKVSNKALPAPIEKTISKAKGQPREPQVYTLPPSREEMTKN QVSLTCDVSGFYPSDIAVEWESDGQPENNYKTTPPVLDSDGSFFLYS KLTVDKSRWEQGDVFSCSVMHEALHNHYTQKSLSLSPGK |
| SEQ ID NO: 318 | Heavy chain 2 (scFv-Fc) | EVQLVESGGGLVQPGGSLRLSCAASGFTFSTYAMNWVRQAPGKGL EWVGRIRSKYNNYATYYADSVKGRFTISRDDSKNTLYLQMNSLRA EDTAVYYCVRHGNFGDSYVSWFAYWGQGTLVTVSSGKPGSGKPG SGKPGSGKPGSQAVVTQEPSLTVSPGGTVTLTCGSSTGAVTTSNYA NWVQQKPGKSPRGLIGGTNKRAPGVPARFSGSLLGGKAALTISGAQ PEDEADYYCALWYSNHWVFGGGTKLTVLEPKSSDKTHTCPPCPAP PVAGPSVFLFPPKPKDTLMISRTPEVTCVVVDVKHEDPEVKFNWYV |

TABLE 13-continued

Amino acid sequences of exemplary anti-CD3 bispecific antibody molecules

|  |  |  |
|---|---|---|
|  |  | DGVEVHNAKTKPREEQYNSTYRVVSVLTVLHQDWLNGKEYKCKV<br>SNKALPAPIEKTISKAKGQPREPQVYTLPPSREQMTKNQVKLTCLVK<br>GFYPSDIAVEWESNGQPENNYKTTPPVLDSDGSFFLYSKLTVDKSR<br>WQQGNVFSCSVMHEALHNHYTQKSLSLSPGK |
| SEQ ID NO: 319 | Light chain | QIVLTQSPSSLSASVGDRVTITCRASSSVSYIHWFQQKPGKSPKPLIY<br>ATSNLASGVPVRFSGSGSGTDYTLTISSLQPEDFATYYCQQWTSNPP<br>TFGGGTKVEIKRTVAAPSVFIFPPSDEQLKSGTASVVCLLNNFYPRE<br>AKVQWKVDNALQSGNSQESVTEQDSKDSTYSLSSTLTLSKADYEK<br>HKVYACEVTHQGLSSPVTKSFNRGEC |

IL15/IL-15Ra Complexes

In certain embodiments, the anti-human ENTPD2 antibody as described herein is administered in combination with an IL-15/IL-15Ra complex. In some embodiments, the IL-15/IL-15Ra complex is chosen from NIZ985 (Novartis), ATL-803 (Altor) or CYP0150 (Cytune).

Exemplary IL-15/IL-15Ra Complexes

In one embodiment, the IL-15/IL-15Ra complex comprises human IL-15 complexed with a soluble form of human IL-15Ra. The complex may comprise IL-15 covalently or noncovalently bound to a soluble form of IL-15Ra. In a particular embodiment, the human IL-15 is noncovalently bonded to a soluble form of IL-15Ra. In a particular embodiment, the human IL-15 of the composition comprises an amino acid sequence of SEQ ID NO: 1001 in Table 14 and the soluble form of human IL-15Ra comprises an amino acid sequence of SEQ ID NO:1002 in Table 14, as described in WO 2014/066527, incorporated by reference in its entirety. The molecules described herein can be made by vectors, host cells, and methods described in WO 2007/084342, incorporated by reference in its entirety.

TABLE 14

Amino acid and nucleotide sequences of exemplary IL-15/IL-15Ra complexes NIZ985

| SEQ ID NO: 1001 | Human IL-15 | NWVNVISDLKKIEDLIQSMHIDATLYTES<br>DVHPSCKVTAMKCFLLELQVISLESGDAS<br>IHDTVENLIILANNSLSSNGNVTESGCKE<br>CEELEEKNIKEFLQSFVHIVQ1VIFINTS |
|---|---|---|
| SEQ ID NO: 1002 | Human Soluble IL-15Ra | ITCPPPMSVEHADIWVKSYSLYSRERYIC<br>NSGFKRKAGTSSLTECVLNKATNVAHWTT<br>PSLKCIRDPALVHQRPAPPSTVTTAGVTP<br>QPESLSPSGKEPAASSPSSNNTAATTAAI<br>VPGSQLMPSKSPSTGTTEISSHESSHGTP<br>SQTTAKNWELTASASHQPPGVYPQG |

Other Exemplary IL-15/IL-15Ra Complexes

In one embodiment, the IL-15/IL-15Ra complex is ALT-803, an IL-15/IL-15Ra Fc fusion protein (IL-15N72D:IL-15RaSu/Fc soluble complex). ALT-803 is disclosed in WO 2008/143794, incorporated by reference in its entirety. In one embodiment, the IL-15/IL-15Ra Fc fusion protein comprises the sequences as disclosed in Table 15.

In one embodiment, the IL-15/IL-15Ra complex comprises IL-15 fused to the sushi domain of IL-15Ra (CYP0150, Cytune). The sushi domain of IL-15Ra refers to a domain beginning at the first cysteine residue after the signal peptide of IL-15Ra, and ending at the fourth cysteine residue after said signal peptide. The complex of IL-15 fused to the sushi domain of IL-15Ra is disclosed in WO 2007/04606 and WO 2012/175222, incorporated by reference in their entirety. In one embodiment, the IL-15/IL-15Ra sushi domain fusion comprises the sequences as disclosed in Table 15.

In one embodiment, the IL-15/IL-15Ra complex comprises a fusion protein of IL-15 and IL-15Ra, which may further comprise a linker, particularly a glycine-serine linker, connecting the IL-15 and IL-15Ra as disclosed in WO 2014/186469 (Board of Regents, the University of Texas System), incorporated by reference in its entirety. In one embodiment, the IL-15/IL-15Ra fusion protein comprises the sequence as disclosed in Table 15.

In one embodiment, the IL-15/IL-15Ra complex comprises a fusion protein of a sushi domain of IL-15Ra and IL-15, linked by a glycine-serine linker, as disclosed in WO 2015/109124 (Kadmon Corp.), incorporated by reference in its entirety. In one embodiment, the IL-15/IL-15Ra fusion protein comprises the sequence as disclosed in Table 15.

In one embodiment, the IL-15/IL-15Ra complex comprises a fusion protein of IL-15, IL-15Ra, a Fc domain and a RGD peptide, preferably configured as RGD polypeptide-Fc domain-IL-15 polypeptide-IL-15Ra polypeptide, as disclosed in WO 2017/000913 (Numab Biopharmaceuticals), incorporated by reference in its entirety. In one embodiment, the RGD-Fc-IL-15-IL-15Ra fusion protein comprises the sequence as disclosed in Table 15.

In one embodiment, the IL-15/IL-15Ra complex comprises a heterodimeric protein comprising IL-15 linked to a first Fc domain and IL-15Ra linked to a second Fc domain. The IL-15 is the mature form of human IL-15 and the IL-15Ra is the extracellular domain of human IL-15Ra or a truncated variant thereof such as IL-15Ra-sushi. The two Fc domains may comprise mutations to enable heterodimer formation via "Knob-into-Hole" interactions and exemplary constructs are disclosed in WO 2015/103928 (Jiangsu Hendrui Medicine Co), incorporated by reference in its entirety.

In one embodiment, the IL-15/IL-15Ra complex comprises a combination of IL-15 comprising a cys amino acid mutation and IL-15Ra (extracellular or sushi domain thereof) comprising a cys mutation to facilitate the formation of intramolecular disulfide bonds between the polypeptides. Sequences of IL-15 and IL-15Ra with mutation combinations are disclosed in WO 2016/095642 (Jiangsu Hendrui Medicine Co), incorporated by reference in its entirety.

In one embodiment, the IL-15/IL-15Ra complex comprises a heterodimeric protein comprising IL-15 linked to a first Fc domain and IL-15Ra linked to a second Fc domain. The first and second Fc domains may have a set of amino acid substitutions as listed: S267K/L368D/K370S: S267K/LS364K/E357Q; S364K/E357Q: L36HD/K370S; L36HD/K370S; S364K; L36HE/K370S: S364K; T411T/E360E/Q362E: D401K; L368D/K370S: S364K/E357L and K370S; S364K/E357Q, according to EU numbering, and in addition may comprise further amino acid substitutions and substitutions to ablate Fcgamma receptor binding as disclosed in WO 2018/071919 (Xencor, Inc.), incorporated by reference in its entirety.

TABLE 15

Amino acid sequences of other exemplary IL-15/IL-15Ra complexes

ALT-803 (Altor)

| | | |
|---|---|---|
| SEQ ID NO: 1003 | IL-15N72D | NWVNVISDLKKIEDLIQSMHIDATLYTESDVHPSCKVTAMKCFLLEL QVISLESGDASIHDTVENLIILANDSLSSNGNVTESGCKECEELEEKNI KEFLQSFVHIVQIVIFINTS |
| SEQ ID NO: 1004 | IL-15RaSu/Fc | ITCPPPMSVEHADIWVKSYSLYSRERYICNSGFKRKAGTSSLTECVLN KATNVAHWTTPSLKCIREPKSCDKTHTCPPCPAPELLGGPSVFLFPPK PKDTLMISRTPEVTCVVVDVSHEDPEVKFNWYVDGVEVHNAKTKPR EEQYNSTYRVVSVLTVLHQDWLNGKEYKCKVSNKALPAPIEKTISKA KGQPREPQVYTLPPSRDELTKNQVSLTCLVKGFYPSDIAVEWESNGQ PENNYKTTPPVLDSDGSFFLYSKLTVDKSRWQQGNVFSCSVMHEAL HNHYTQKSLSLSPGK |

IL-15/IL-15Ra sushi domain fusion (Cytune)

| | | |
|---|---|---|
| SEQ ID NO: 1005 | Human IL-15 | NWVNVISDLKKIEDLIQSMHIDATLYTESDVHPSCKVTAMKCFLLEL QVISLESGDASIHDTVENLIILANNSLSSNGNVTESGCKECEELEXKNI KEFLQSFVHIVQMFINTS<br>Where X is E or K |
| SEQ ID NO: 1006 | Human IL-15Ra sushi and hinge domains | ITCPPPMSVEHADIWVKSYSLYSRERYICNSGFKRKAGTSSLTECVLN KATNVAHWTTPSLKCIRDPALVHQRPAPP |

IL-15/IL-15Ra fusion protein (University of Texas)

| | | |
|---|---|---|
| SEQ ID NO: 1007 | IL-15/IL-15Ra fusion protein with Gly-Ser linker | MDWTWILFLVAAATRVHSNWVNVISDLKKIEDLIQSMHI DATLYTESDVHPSCKVTAMKCFLLELQVISLESGDASIHD TVENLIILANNSLSSNGNVTESGCKECEELEEKNIKEFLQS FVHIVQMFINTSSGGGSGGGGSGGGGSGGGGSGGGSLQI TCPPPMSVEHADIWVKSYSLYSRERYICNSGFKRKAGTSS LTECVLNKATNVAHWTTPSLKCIRDPALVHQRPAPPSTV TTAGVTPQPESLSPSGKEPAASSPSSNNTAATTAAIVPGSQ LMPSKSPSTGTTEISSHESSHGTPSQTTAKNWELTASASH QPPGVYPQGHSDTTVAISTSTVLLCGLSAVSLLACYLKSR QTPPLASVEMEAMEALPVTWGTSSRDEDLENCSHHLSR MDYKDDDDKDYKDDDDKDYKDDDDK |

IL-15Ra/IL-15 fusion protein (Kadmon Corp.)

| | | |
|---|---|---|
| SEQ ID NO: 1008 | Sushi-IL-15Ra/IL-15 fusion protein with Gly-Ser linker | CPPPMSVEHADIWVKSYSLYSRERYICNSGFKRKAGTSSL TECVLNKATNVAHWTTPSLKCIRDPALVHQRPAPPSGGS GGGGSGGGSGGGGSLQNWVNVISDLKKIEDLIQSMHIDA TLYTESDVHPSCKVTAMKCFLLELQVISLESGDASIHDTV ENLIILANNSLSSNGNVTESGCKECEELEEKNIKEFLQSFV HIVQMFINTS |

RGD-Fc-IL-15-IL-15Ra fusion protein (Numab Biopharmaceuticals)

| | | |
|---|---|---|
| SEQ ID NO: 1009 | RGD-Fc-IL-15-IL-15Ra | ACDCRGDCFCGGGGGSDKTHTCPPCPAPELLGGPSVFLF PPKPKDTLMISRTPEVTCVVVDVSHEDPEVKFNWYVDG VEVHNAKTKPREEQYNSTYRVVSVLTVLHQDWLNGKE YKCKVSNKALPAPIEKTISKAKGQPREPQVYTLPPSRDEL TKNQVS LTCLVKGFYPSDIAVEWESNGQPENNYKTTPPVLDSDGS FFLYSKLTVDKSRWQQGNVFSCSVMHEALHNHYTQKSL SLSPGKGGGGSPPPMSVEHADIWVKSYSLYSRERYICNSG FKRKAGTSSLTECVLNKATNVAHWTTPSLKCIRDPALVH QRPAPPSTVSGGSGGGGSGGGSGGGGSLQNWVNVISDL KKIEDLIQSMHIDATLYTESDVHPSCKVTAMKCFLLELQV ISLESGDASIHDTVENLIILANNSLSSNGNVTESGCKECEE LEEKNIKEFLQSFVHIVQMFINTS |

Exemplary CSF-1/1R Binding Agents

In certain embodiments, the anti-human ENTPD2 antibody molecule described herein is administered in combination with a CSF-1/1R binding agent.

In some embodiments, the CSF-1/1R binding agent is an inhibitor of macrophage colony-stimulating factor (M-CSF). M-CSF is also sometimes known as CSF-1.

In another embodiment, the CSF-1/1R binding agent is a CSF-1R tyrosine kinase inhibitor, 4-((2-(((1R,2R)-2-hydroxycyclohexyl)amino)benzo[d]thiazol-6-yl)oxy)-N-methylpicolinamide (Compound A15), or a compound disclosed in PCT Publication No. WO 2005/073224. In some embodiments, the CSF-1/1R binding agent is an M-CSF inhibitor, Compound A33, or a binding agent to CSF-1 disclosed in PCT Publication No. WO 2004/045532 or PCT Publication No WO 2005/068503 including RX1 or 5H4 (e.g., an antibody molecule or Fab fragment against M-CSF).

In some embodiments, the CSF-1/1R binding agent is a CSF1R inhibitor or 4-(2-((1R,2R)-2-hydroxycyclohexylamino)benzothiazol-6-yloxy)-N-methylpicolinamide. 4-(2-((1R,2R)-2-hydroxycyclohexylamino)benzothiazol-6-yloxy)-N-methylpicolinamide is disclosed as example 157 at page 117 of PCT Publication No. WO 2007/121484.

In some embodiments, the CSF-1/1R binding agent is pexidartinib (CAS Registry Number 1029044-16-3). Pexidartinib is also known as PLX3397 or 5-((5-chloro-1H-pyrrolo[2,3-b]pyridin-3-yl)methyl)-N-((6-(trifluoromethyl)pyridin-3-yl)methyl)pyridin-2-amine. Pexidartinib is a small-molecule receptor tyrosine kinase (RTK) inhibitor of KIT, CSF1R and FLT3.

In some embodiments, the CSF-1/1R binding agent is emactuzumab. Emactuzumab is also known as RG7155 or RO5509554. Emactuzumab is a humanized IgG1 mAb targeting CSF1R.

In some embodiments, the CSF-1/1R binding agent is FPA008. FPA008 is a humanized mAb that inhibits CSF1R.

Exemplary IDO/TDO Inhibitors

In certain embodiments, the anti-human ENTPD2 antibody molecule described herein is administered in combination with an inhibitor of indoleamine 2,3-dioxygenase (IDO) and/or tryptophan 2,3-dioxygenase (TDO).

In some embodiments, the IDO/TDO inhibitor is chosen from (4E)-4-[(3-chloro-4-fluoroanilino)-nitrosomethylidene]-1,2,5-oxadiazol-3-amine (also known as INCB24360 or Epacadostat; CAS Registry Number: 1204669-58-8 (Incyte)), Indoximod (1-methyl-D-tryptophan), α-cyclohexyl-5H-Imidazo[5,1-a]isoindole-5-ethanol (also known as NLG919) or BMS-986205 (also known as F001287 or ONO-7701).

In some embodiments, the IDO/TDO inhibitor is Epacadostat. It is a potent and selective indoleamine 2,3-dioxygenase (IDO1) inhibitor with an $IC_{50}$ of 10 nM. Epacadostat is highly selective over other related enzymes such as IDO2 or tryptophan 2,3-dioxygenase (TDO).

In some embodiments, the IDO/TDO inhibitor is Indoximod (New Link Genetics). Indoximod, the D isomer of 1-methyl-tryptophan, is an orally administered small-molecule indoleamine 2,3-dioxygenase (IDO) pathway inhibitor that disrupts the mechanisms by which tumors evade immune-mediated destruction. NLG919 is a potent IDO pathway inhibitor with a $Ki/EC_{50}$ of 7 nM/75 nM, respectively, in cell free assays.

In some embodiments, the IDO/TDO inhibitor is BMS-986205 (also known as F001287 or ONO-7701) (Flexus/BMS). BMS-986205 is a small molecule inhibitor of indoleamine 2,3-dioxygenase 1 (IDO1).

Exemplary TGF-β Inhibitors

In certain embodiments, the anti-human ENTPD2 antibody molecule described herein is administered in combination with a transforming growth factor beta (TGF-β) inhibitor. The TGF-β inhibitor may be an antibody, an antigen binding fragment thereof, an immunoadhesin, a fusion protein, or an oligopeptide. In some embodiments, the TGF-β inhibitor is chosen from fresolimumab and XOMA 089 (Xoma).

TGF-β belongs to a large family of structurally-related cytokines including, e.g., bone morphogenetic proteins (BMPs), growth and differentiation factors, activins and inhibins. In some embodiments, the TGF-β inhibitors described herein can bind and/or inhibit one or more isoforms of TGF-β (e.g., one, two, or all of TGF-β1, TGF-β2, or TGF-β3).

In some embodiments, the TGF-β inhibitor is fresolimumab (CAS Registry Number: 948564-73-6). Fresolimumab is also known as GC1008. Fresolimumab is a human monoclonal antibody that binds to and inhibits TGF-beta isoforms 1, 2 and 3. Fresolimumab is disclosed, e.g., in WO 2006/086469, U.S. Pat. Nos. 8,383,780, and 8,591,901.

The heavy chain of fresolimumab has the amino acid sequence of:
(SEQ ID NO: 1012)
QVQLVQSGAEVKKPGSSVKVSCKASGYTFSSNVISWVRQAPGQGLEWMGG

VIPIVDIANYAQRFKGRVTITADESTSTTYMELSSLRSEDTAVYYCASTL

GLVLDAMDYWGQGTLVTVSSASTKGPSVFPLAPCSRSTSESTAALGCLVK

DYFPEPVTVSWNSGALTSGVHTFPAVLQSSGLYSLSSVVTVPSSSLGTKT

YTCNVDHKPSNTKVDKRVESKYGPPCPSCPAPEFLGGPSVFLFPPKPKDT

LMISRTPEVTCVVVDVSQEDPEVQFNWYVDGVEVHNAKTKPREEQFNSTY

RVVSVLTVLHQDWLNGKEYKCKVSNKGLPSSIEKTISKAKGQPREPQVYT

LPPSQEEMTKNQVSLTCLVKGFYPSDIAVEWESNGQPENNYKTTPPVLDS

DGSFFLYSRLTVDKSRWQEGNVFSCSVMHEALHNHYTQKSLSLSLGK.

The light chain of fresolimumab has the amino acid sequence of:
(SEQ ID NO: 1013)
ETVLTQSPGTLSLSPGERATLSCRASQSLGSSYLAWYQQKPGQAPRLLIY

GASSRAPGIPDRFSGSGSGTDFTLTISRLEPEDFAVYYCQQYADSPITFG

QGTRLEIKRTVAAPSVFIFPPSDEQLKSGTASVVCLLNNFYPREAKVQWK

VDNALQSGNSQESVTEQDSKDSTYSLSSTLTLSKADYEKHKVYACEVTHQ

GLSSPVTKSFNRGEC.

In some embodiments, the TGF-β inhibitor is XOMA 089. XOMA 089 is also known as XPA.42.089. XOMA 089 is a fully human monoclonal antibody that binds and neutralizes TGF-beta 1 and 2 ligands while sparing TGF-beta 3.

The heavy chain variable region of XOMA 089 has the amino acid sequence of:
(SEQ ID NO: 310)
QVQLVQSGAEVKKPGSSVKVSCKASGGTFSSYAISWVRQAPGQGLEWMGG

IIPIFGTANYAQKFQGRVTITADESTSTAYMELSSLRSEDTAVYYCARGL

WEVRALPSVYWGQGTLVTVSS
(disclosed as SEQ ID NO: 6 in WO2012/167143).

-continued

The light chain variable region of XOMA 089 has the amino acid sequence of:
(SEQ ID NO: 311)
SYELTQPPSVSVAPGQTARITCGANDIGSKSVHWYQQKAGQAPVLVVSED

IIRPSGIPERISGSNSGNTATLTISRVEAGDEADYYCQVWDRDSDQYVFG

TGTKVTVLG
(disclosed as SEQ ID NO: 8 in WO2012/167143).

Exemplary VEGFR Inhibitors

In certain embodiments, the anti-human ENTPD2 antibody molecule described herein is administered in combination with a vascular endothelial growth factor (VEGF) receptor inhibitor (e.g., an inhibitor of one or more of VEGFR (e.g., VEGFR-1, VEGFR-2, or VEGFR-3) or VEGF).

In some embodiments, the VEGFR inhibitor is vatalanib succinate (Compound A47) or a compound disclosed in EP 296122.

In some embodiment, the VEGFR inhibitor is an inhibitor of one or more of VEGFR-2, PDGFRbeta, KIT or Raf kinase C, 1-methyl-5-((2-(5-(trifluoromethyl)-1H-imidazol-2-yl)pyridin-4-yl)oxy)-N-(4-(trifluoromethyl)phenyl)-1H-benzo[d]imidazol-2-amine (Compound A37) or a compound disclosed in PCT Publication No. WO 2007/030377.

Other exemplary VEGFR pathway inhibitors that can be used in the combinations disclosed herein include, e.g., bevacizumab (AVASTIN®), axitinib (INLYTA®); brivanib alaninate (BMS-582664, (S)—((R)-1-(4-(4-Fluoro-2-methyl-1H-indol-5-yloxy)-5-methylpyrrolo[2,1-f][1,2,4]triazin-6-yloxy)propan-2-yl)2-aminopropanoate); sorafenib (NEXAVAR®); pazopanib (VOTRIENT®); sunitinib malate (SUTENT®); cediranib (AZD2171, CAS 288383-20-1); vargatef (BIBF1120, CAS 928326-83-4); Foretinib (GSK1363089); telatinib (BAY57-9352, CAS 332012-40-5); apatinib (YN968D1, CAS 811803-05-1); imatinib (GLEEVEC®); ponatinib (AP24534, CAS 943319-70-8); tivozanib (AV951, CAS 475108-18-0); regorafenib (BAY73-4506, CAS 755037-03-7); vatalanib dihydrochloride (PTK787, CAS 212141-51-0); brivanib (BMS-540215, CAS 649735-46-6); vandetanib (CAPRELSA® or AZD6474); motesanib diphosphate (AMG706, CAS 857876-30-3, N-(2,3-dihydro-3,3-dimethyl-1H-indol-6-yl)-2-[(4-pyridinylmethyl)amino]-3-pyridinecarboxamide, described in PCT Publication No. WO 02/066470); linfanib (ABT869, CAS 796967-16-3); cabozantinib (XL184, CAS 849217-68-1); lestaurtinib (CAS 111358-88-4); N-[5-[[[5-(1,1-dimethylethyl)-2-oxazolyl]methyl]thio]-2-thiazolyl]-4-piperidinecarboxamide (BMS38703, CAS 345627-80-7); (3R,4R)-4-amino-1-((4-((3-methoxyphenyl)amino)pyrrolo[2,1-f][1,2,4]triazin-5-yl)methyl)piperidin-3-ol (BMS690514); N-(3,4-Dichloro-2-fluorophenyl)-6-methoxy-7-[[(3aα,5β,6aα)-octahydro-2-methylcyclopenta[c]pyrrol-5-yl]methoxy]-4-quinazolinamine (XL647, CAS 781613-23-8); 4-methyl-3-[[1-methyl-6-(3-pyridinyl)-1H-pyrazolo[3,4-d]pyrimidin-4-yl]amino]-N-[3-(trifluoromethyl)phenyl]-benzamide (BHG712, CAS 940310-85-0); aflibercept (EYLEA®), and endostatin (ENDOSTAR®).

Exemplary anti-VEGF antibodies that can be used in the combinations disclosed herein include, e.g., a monoclonal antibody that binds to the same epitope as the monoclonal anti-VEGF antibody A4.6.1 produced by hybridoma ATCC HB 10709; a recombinant humanized anti-VEGF monoclonal antibody generated according to Presta et al. (1997) Cancer Res. 57:4593-4599. In one embodiment, the anti-VEGF antibody is Bevacizumab (BV), also known as rhuMAb VEGF or AVASTIN®. It comprises mutated human IgG1 framework regions and antigen-binding complementarity-determining regions from the murine anti-hVEGF monoclonal antibody A.4.6.1 that blocks binding of human VEGF to its receptors. Bevacizumab and other humanized anti-VEGF antibodies are further described in U.S. Pat. No. 6,884,879 issued Feb. 26, 2005. Additional antibodies include the G6 or B20 series antibodies (e.g., G6-31, B20-4.1), as described in PCT Publication No. WO2005/012359, PCT Publication No. WO2005/044853. For additional antibodies, see U.S. Pat. Nos. 7,060,269, 6,582,959, 6,703,020, 6,054,297, WO98/45332, WO 96/30046, WO94/10202, EP 0666868B1, U.S. Patent Application Publication Nos. 2006/009360, 2005/0186208, 2003/0206899, 2003/0190317, 2003/0203409, and 2005/0112126; and Popkov et al, Journal of Immunological Methods 288: 149-164 (2004). Other antibodies include those that bind to a functional epitope on human VEGF comprising of residues F17, Ml 8, D19, Y21, Y25, Q89, 191, Kl 01, El 03, and C104 or, alternatively, comprising residues F17, Y21, Q22, Y25, D63, 183 and Q89.

Exemplary EGFR Inhibitors

In some embodiments, the anti-human ENTPD2 antibody molecule, e.g., the anti-ENTPD2 antibody molecule described herein, is used, in combination with a tyrosine kinase inhibitor (e.g., a receptor tyrosine kinase (RTK) inhibitor). Exemplary tyrosine kinase inhibitor include, but are not limited to, an epidermal growth factor (EGF) pathway inhibitor (e.g., an epidermal growth factor receptor (EGFR) inhibitor), a vascular endothelial growth factor (VEGF) pathway inhibitor (e.g., a vascular endothelial growth factor receptor (VEGFR) inhibitor (e.g., a VEGFR-1 inhibitor, a VEGFR-2 inhibitor, a VEGFR-3 inhibitor)), a platelet derived growth factor (PDGF) pathway inhibitor (e.g., a platelet derived growth factor receptor (PDGFR) inhibitor (e.g., a PDGFR-β inhibitor)), a RAF-1 inhibitor, a KIT inhibitor and a RET inhibitor. In certain embodiments, the anti-human ENTPD2 antibody molecule described herein is administered in combination with an inhibitor of Epidermal Growth Factor Receptor (EGFR).

In some embodiments, the EGFR inhibitor is (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757.

In some embodiments, the EGFR inhibitor is chosen from one of more of erlotinib (Tarceva®), gefitinib (Iressa®), cetuximab (Erbitux®), panitumumab (Vectibix®), necitumumab (Portrazza®), dacomitinib, nimotuzumab, Imgatuzumab, afatinib, or osimertinib (Tagrisso).

Other anticancer agents, e.g., tyrosine kinase inhibitors pathway inhibitors, that can be used in the combinations disclosed herein include, but are not limited to, Selected tyrosine kinase inhibitors are chosen from sunitinib (Sutent®), or sorafenib (Nexavar®).

In some embodiments, the anti-cancer agent used in combination with the hedgehog inhibitor is selected from the group consisting of: axitinib (AG013736), bosutinib (SKI-606), cediranib (RECENTIN™, AZD2171), dasatinib (SPRYCEL®, BMS-354825), erlotinib (TARCEVA®), gefitinib (IRESSA®), imatinib (Gleevec®, CGP57148B, STI-571), lestaurtinib (CEP-701), neratinib (HKI-272), nilotinib (TASIGNA®), semaxanib (semaxinib, SU5416), sunitinib (SUTENT®, SU11248), toceranib (PALLADIA®), vandetanib (ZACTIMA®, ZD6474), vatalanib (PTK787, PTK/ZK), trastuzumab (HERCEPTIN®), bevacizumab (AVASTIN®), rituximab (RITUXAN®), cetuximab (ERBITUX®), panitumumab (VECTIBIX®), ranibizumab (Lucentis®), nilotinib (TASIGNA®), sorafenib (NEXAVAR®), alemtuzumab (CAMPATH®), gemtuzumab ozogamicin (MYLOTARG®), ENMD-2076, PCI-32765, AC220, BIBW 2992 (TOVOK™), SGX523, PF-04217903, PF-02341066, PF-299804, BMS-777607, ABT-869, MP470, BIBF 1120 (VARGATEF®), AP24534, JNJ-26483327, MGCD265, DCC-2036, BMS-690154, CEP-11981, tivozanib (AV-951), OSI-930, MM-121, XL-184, XL-647, XL228, AEE788, AG-490, AST-6, BMS-599626, CUDC-101, PD153035, pelitinib (EKB-569), vandetanib (zactima), WZ3146, WZ4002, WZ8040, ABT-869 (linifanib), AEE788, AP24534 (ponatinib), AV-951 (tivozanib), axitinib, BAY 73-4506 (regorafenib), brivanib alaninate (BMS-582664), brivanib (BMS-540215), cediranib (AZD2171), CP 673451, CYC116, E7080, Ki8751, masitinib (AB1010), MGCD-265, motesanib diphosphate (AMG-706), MP-470, OSI-930, Pazopanib Hydrochloride, PD173074, Sorafenib Tosylate (Bay 43-9006), SU 5402SU 5402, TSU-68 (SU6668), vatalanib, XL880 (GSK1363089, EXEL-2880).

Exemplary c-MET Inhibitors

In certain embodiments, the anti-human ENTPD2 antibody molecule described herein is administered in combination with an inhibitor of c-MET.

In some embodiments, the c-MET inhibitor is Compound A17 or a compound described in U.S. Pat. Nos. 7,767,675 and 8,420,645).

In some embodiments, the c-MET inhibitor is JNJ-38877605. JNJ-38877605 is an orally available, small molecule inhibitor of c-Met. JNJ-38877605 selectively binds to c-MET, thereby inhibiting c-MET phosphorylation and disrupting c-Met signal transduction pathways.

In some embodiments, the c-Met inhibitor is AMG 208. AMG 208 is a selective small-molecule inhibitor of c-MET. AMG 208 inhibits the ligand-dependent and ligand-independent activation of c-MET, inhibiting its tyrosine kinase activity, which may result in cell growth inhibition in tumors that overexpress c-Met.

In some embodiments, the c-Met inhibitor is AMG 337. AMG 337 is an orally bioavailable inhibitor of c-Met. AMG 337 selectively binds to c-MET, thereby disrupting c-MET signal transduction pathways.

In some embodiments, the c-Met inhibitor is LY2801653. LY2801653 is an orally available, small molecule inhibitor of c-Met. LY2801653 selectively binds to c-MET, thereby inhibiting c-MET phosphorylation and disrupting c-Met signal transduction pathways.

In some embodiments, c-Met inhibitor is MSC2156119J. MSC2156119J is an orally bioavailable inhibitor of c-Met. MSC2156119J selectively binds to c-MET, which inhibits c-MET phosphorylation and disrupts c-Met-mediated signal transduction pathways.

In some embodiments, the c-MET inhibitor is capmatinib. Capmatinib is also known as INCB028060. Capmatinib is an orally bioavailable inhibitor of c-MET. Capmatinib selectively binds to c-Met, thereby inhibiting c-Met phosphorylation and disrupting c-Met signal transduction pathways.

In some embodiments, the c-MET inhibitor is crizotinib. Crizotinib is also known as PF-02341066. Crizotinib is an orally available aminopyridine-based inhibitor of the receptor tyrosine kinase anaplastic lymphoma kinase (ALK) and the c-Met/hepatocyte growth factor receptor (HGFR). Crizotinib, in an ATP-competitive manner, binds to and inhibits ALK kinase and ALK fusion proteins. In addition, crizotinib inhibits c-Met kinase, and disrupts the c-Met signaling pathway. Altogether, this agent inhibits tumor cell growth.

In some embodiments, the c-MET inhibitor is golvatinib. Golvatinib is an orally bioavailable dual kinase inhibitor of c-MET and VEGFR-2 with potential antineoplastic activity. Golvatinib binds to and inhibits the activities of both c-MET and VEGFR-2, which may inhibit tumor cell growth and survival of tumor cells that overexpress these receptor tyrosine kinases.

In some embodiments, the c-MET inhibitor is tivantinib. Tivantinib is also known as ARQ 197. Tivantinib is an orally bioavailable small molecule inhibitor of c-MET. Tivantinib binds to the c-MET protein and disrupts c-Met signal transduction pathways, which may induce cell death in tumor cells overexpressing c-MET protein or expressing constitutively activated c-Met protein.

Exemplary IAP Inhibitors

In certain embodiments, the anti-human ENTPD2 antibody molecule described herein is administered in combination with an inhibitor of Inhibitor of Apoptosis Protein (IAP).

In some embodiments, the IAP inhibitor is (S)—N—((S)-1-cyclohexyl-2-((S)-2-(4-(4-fluorobenzoyl)thiazol-2-yl)pyrrolidin-1-yl)-2-oxoethyl)-2-(methylamino)propanamide (Compound A21) or a compound disclosed in U.S. Pat. No. 8,552,003.

Exemplary mTOR Inhibitors

In certain embodiments, the anti-human ENTPD2 antibody molecule described herein is administered in combination with an inhibitor of mammalian target of rapamycin (mTOR).

In some embodiments, the mTOR inhibitor is 8-(6-Methoxy-pyridin-3-yl)-3-methyl-1-(4-piperazin-1-yl-3-trifluoromethyl-phenyl)-1,3-dihydro-imidazo[4,5-c]quinolin-2-one (Compound A41).

In some embodiments, the mTOR inhibitor is everolimus (also known as RAD001 or AFINITOR®; Compound A36) or a compound first disclosed in PCT Publication No. WO 94/09010.

In some embodiments, the mTOR inhibitor is chosen from one or more of temsirolimus (TORISEL®), PF-4691502, GDC0980, OSI-027, GSK1059615, KU-0063794, WYE-354, Palomid 529 (P529), PF-04691502, gedatolisib (PF-05212384, PKI-587), ridaforolimus (formally known as deferolimus, (1R,2R,4S)-4-[(2R)-2 [(1R,9S,12S,15R,16E,18R,19R,21R,23S,24E,26E,28Z,30S,32S,35R)-1,18-dihydroxy-19,30-dimethoxy-15,17,21,23,29,35-hexamethyl-2,3,10,14,20-pentaoxo-11,36-dioxa-4-azatricyclo[30.3.1.04,9]hexatriaconta-16,24,26,28-tetraen-12-yl]propyl]-2-methoxycyclohexyl dimethylphosphinate, also known as AP23573 and MK8669, and described in PCT Publication No. WO 03/064383); rapamycin (AY22989, SIROLIMUS®); simapimod (CAS Registry Number: 164301-51-3); (5-{2,4-Bis[(3S)-3-methylmorpholin-4-yl]pyrido[2,3-d]pyrimidin-7-yl}-2-methoxyphenyl)methanol (AZD8055); 2-Amino-8-[trans-4-(2-hydroxyethoxy)cyclohexyl]-6-(6-methoxy-3-pyridinyl)-4-methyl-pyrido[2,3-d]pyrimidin-7 (8H)-one (PF04691502, CAS Registry Number: 1013101-36-4); N2-[1,4-dioxo-4-[[4-(4-oxo-8-phenyl-4H-1-benzopyran-2-yl)morpholinium-4-yl]methoxy]butyl]-L-arginylglycyl-L-α-aspartylL-serine inner salt (SF1126, CAS Registry Number: 936487-67-1) (SEQ ID NO: 1011), or XL765 (SAR245409).

Exemplary PI3K-γ, -δ Inhibitors

In certain embodiments, the anti-human ENTPD2 antibody molecule described herein is administered in combination with an inhibitor of phosphatidylinositol-4,5-bisphosphate 3-kinase (PI3K), e.g., phosphatidylinositol-4,5-bisphosphate 3-kinase gamma and/or delta (PI3K-γ,δ).

In some embodiments, the PI3K inhibitor is an inhibitor of delta and gamma isoforms of PI3K. Exemplary PI3K inhibitors that can be used in combination are described in, e.g., WO 2010/036380, WO 2010/006086, WO 09/114870, WO 05/113556. In some embodiments, the PI3K inhibitor is chosen from one or more of GSK 2126458, GDC-0980, GDC-0941, Sanofi XL147, XL756, XL147, PF-46915032, CAL-101, CAL 263, SF1126, PX-886, and a dual PI3K inhibitor.

In some embodiments, the PI3K-γ,δ inhibitor is idelalisib (CAS Registry Number: 870281-82-6). Idelalisib is also known as ZYDELIG®, GS-1101, CAL-101, or 5-Fluoro-3-phenyl-2-[(1S)-1-(7H-purin-6-ylamino)propyl]-4(3H)-quinazolinone. Idelalisib blocks P110δ, the delta isoform of PI3K. Idelalisib is disclosed, e.g., in Wu et al. *Journal of Hematology & Oncology* (2013) 6: 36.

In some embodiments, the PI3K-γ,δ inhibitor is 8-(6-Methoxy-pyridin-3-yl)-3-methyl-1-(4-piperazin-1-yl-3-trifluoromethyl-phenyl)-1,3-dihydro-imidazo[4,5-c]quinolin-2-one (Compound A41).

Other exemplary PI3K-γ,δ inhibitors that can be used in the combination include, e.g., pictilisib (GDC-0941), LY294002, pilaralisib (XL147), PI-3065, PI-103, VS-5584 (SB2343), CZC24832, duvelisib (IPI-145, INK1197), TG100-115, CAY10505, GSK1059615, PF-04691502, AS-605240, voxtalisib (SAR245409, XL765), IC-87114, omipalisib (GSK2126458, GSK458), TG100713, gedatolisib (PF-05212384, PKI-587), PKI-402, XL147 analogue, PIK-90, PIK-293, PIK-294, 3-Methyladenine (3-MA), AS-252424, AS-604850, or apitolisib (GDC-0980, RG7422).

In some embodiments, the PI3K inhibitor is Compound A8 or a compound described in PCT Publication No. WO2010/029082.

In some embodiments, the PI3K inhibitor is a pan-PI3K inhibitor, (4S,5R)-3-(2'-amino-2-morpholino-4'-(trifluoromethyl)-[4,5'-bipyrimidin]-6-yl)-4-(hydroxymethyl)-5-methyloxazolidin-2-one (Compound A13) or a compound disclosed in PCT Publication No. WO2013/124826.

Exemplary PI3K-γ, -δ inhibitors include, but are not limited to, duvelisib and idelalisib. Idelalisib (also called GS-1101 or CAL-101; Gilead) is a small molecule that blocks the delta isoform of PI3K. The structure of idelalisib (5-Fluoro-3-phenyl-2-[(1S)-1-(7H-purin-6-ylamino)propyl]-4(3H)-quinazolinone) is shown below.

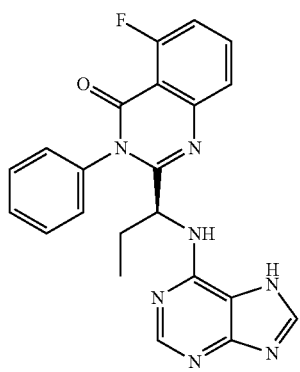 [SMILES: CC[C@H](Nc1ncnc2nc[nH]c12)c1nc2cccc(F)c2c(=O)n1-c1ccccc1]

Duvelisib (also called IPI-145; Infinity Pharmaceuticals and Abbvie) is a small molecule that blocks PI3K-δ,γ. The structure of duvelisib (8-Chloro-2-phenyl-3-[(1S)-1-(9H-purin-6-ylamino)ethyl]-1(2H)-isoquinolinone) is shown below.

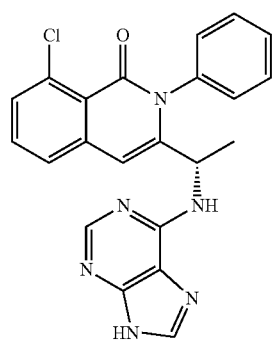 [SMILES: C[C@H](Nc1ncnc2[nH]cnc12)c1cc2cccc(Cl)c2c(=O)n1-c1ccccc1]

In one embodiment, the inhibitor is a dual phosphatidylinositol 3-kinase (PI3K) and mTOR inhibitor selected from 2-Amino-8-[trans-4-(2-hydroxyethoxy)cyclohexyl]-6-(6-methoxy-3-pyridinyl)-4-methyl-pyrido[2,3-d]pyrimidin-7(8H)-one (PF-04691502); N-[4-[[4-(Dimethylamino)-1-piperidinyl]carbonyl]phenyl]-N'-[4-(4,6-di-4-morpholinyl-1,3,5-triazin-2-yl)phenyl]urea (PF-05212384, PKI-587); apitolisib (GDC-0980, RG7422); 2,4-Difluoro-N-{2-(methyloxy)-5-[4-(4-pyridazinyl)-6-quinolinyl]-3-pyridinyl}benzenesulfonamide (GSK2126458); 8-(6-methoxypyridin-3-yl)-3-methyl-1-(4-(piperazin-1-yl)-3-(trifluoromethyl)phenyl)-1H-imidazo[4,5-c]quinolin-2(3H)-one Maleic acid (NVP-BGT226); 3-[4-(4-Morpholinylpyrido[3',2':4,5]furo[3,2-d]pyrimidin-2-yl] phenol (PI-103); 5-(9-isopropyl-8-methyl-2-morpholino-9H-purin-6-yl)pyrimidin-2-amine (VS-5584, SB2343); or N-[2-[(3,5-Dimethoxyphenyl)amino]quinoxalin-3-yl]-4-[(4-methyl-3-methoxyphenyl)carbonyl]aminophenylsulfonamide (XL765).

Exemplary JAK Inhibitors

In certain embodiments, the anti-human ENTPD2 antibody molecule described herein is administered in combination with an inhibitor of Janus kinase (JAK).

In some embodiments, the JAK inhibitor is 2-fluoro-N-methyl-4-(7-(quinolin-6-ylmethyl)imidazo[1,2-b][1,2,4]triazin-2-yl)benzamide (Compound A17), or a dihydrochloric salt thereof, or a compound disclosed in PCT Publication No. WO 2007/070514.

In some embodiment, the JAK inhibitor is ruxolitinib phosphate (also known as JAKAFI; Compound A18) or a compound disclosed in PCT Publication No. WO 2007/070514.

In certain embodiments, any of the combinations disclosed herein, alternatively or in combination, further includes one or more of the agents described in Table 16.

TABLE 16

Selected therapeutic agents that can be administered in combination with the
anti-human ENTPD2 antibody molecules, e.g., as a single agent or in combination with
other immunomodulators described herein. Each publication listed in this Table is
herein incorporated by reference in its entirety, including all structural formulae therein.

| Compound Designation | Generic Name Tradename | Compound Structure | Patents/Patent Application Publications |
|---|---|---|---|
| A1 | Sotrastaurin | 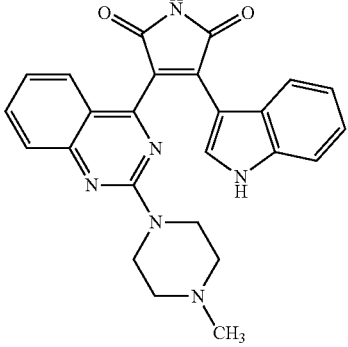 | EP 1682103<br>US 2007/142401<br>WO 2005/039549 |
| A2 | Nilotinib HCl monohydrate TASIGNA ®  | 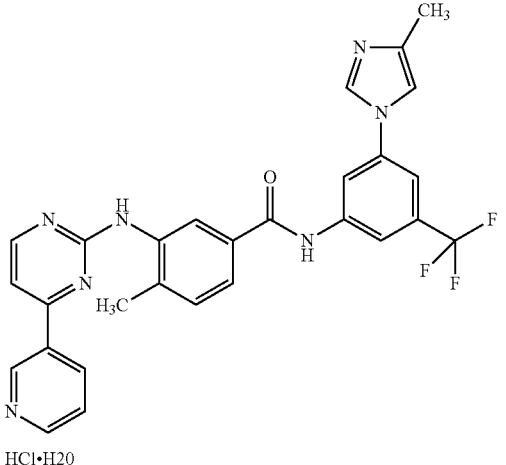 [SMILES: Cc1cn(-c2cc(NC(=O)c3ccc(C)c(Nc4nccc(-c5cccnc5)n4)c3)cc(C(F)(F)F)c2)cn1]<br>HCl•H2O | WO 2004/005281<br>U.S. Pat. No. 7,169,791 |
| A3 | | 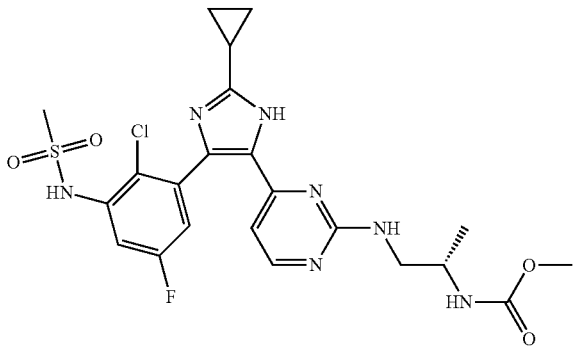 [SMILES: COC(=O)N[C@@H](C)CNc1nccc(-c2[nH]c(C3CC3)nc2-c2cc(F)cc(NS(C)(=O)=O)c2Cl)n1] | WO2011/023773 |
| A4 | | 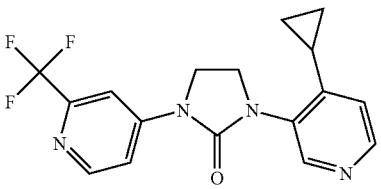 [SMILES: O=C1N(c2ccnc(C(F)(F)F)c2)CCN1c1cnccc1C1CC1] | WO2012/149413 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A7 |  | 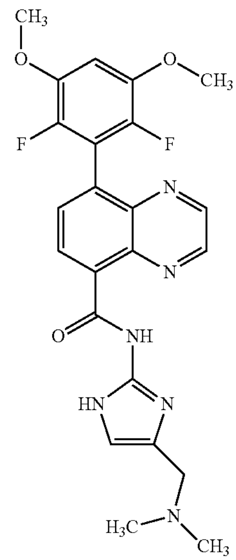 [SMILES: COc1cc(OC)c(F)c(-c2ccc(C(=O)Nc3nc(CN(C)C)c[nH]3)c3nccnc23)c1F] | WO 2009/141386<br>US 2010/0105667 |
| A8 |  | 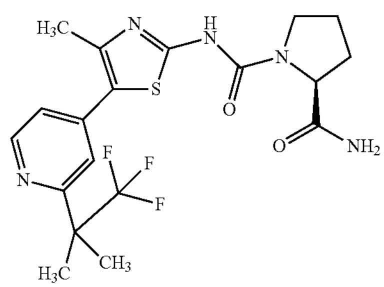 [SMILES: Cc1nc(NC(=O)N2CCC[C@H]2C(N)=O)sc1-c1ccnc(C(C)(C)C(F)(F)F)c1] | WO 2010/029082 |
| A10 |  | 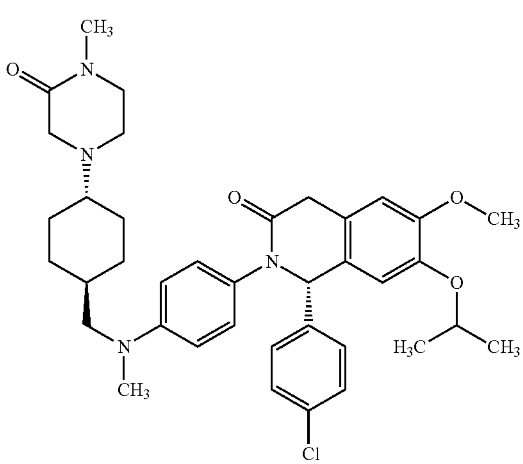 [SMILES: COc1cc2c(cc1OC(C)C)[C@H](c1ccc(Cl)cc1)N(c1ccc(N(C)C[C@H]3CC[C@H](N4CCN(C)C(=O)C4)CC3)cc1)C(=O)C2] | WO 2011/076786 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A11 | Deferasirox EXJADE ® | 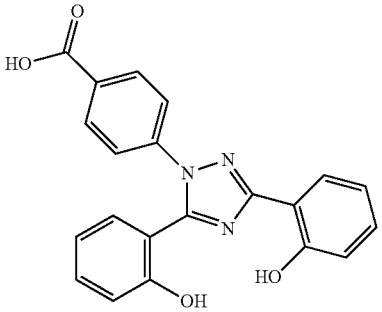 [SMILES: O=C(O)c1ccc(-n2nc(-c3ccccc3O)nc2-c2ccccc2O)cc1] | WO 1997/049395 |
| A12 | Letrozole FEMARA ® | 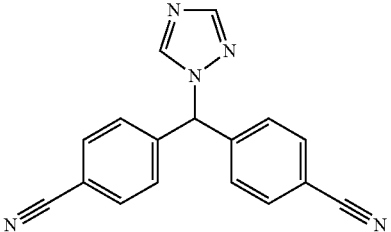 [SMILES: N#Cc1ccc(C(c2ccc(C#N)cc2)n2cncn2)cc1] | U.S. Pat. No. 4,978,672 |
| A13 | | 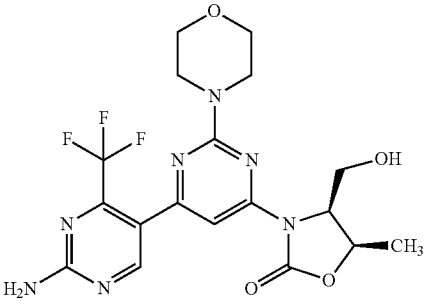 [SMILES: C[C@H]1OC(=O)N(c2cc(-c3cnc(N)nc3C(F)(F)F)nc(N3CCOCC3)n2)[C@H]1CO] | WO 2013/124826 US 2013/0225574 |
| A14 | | 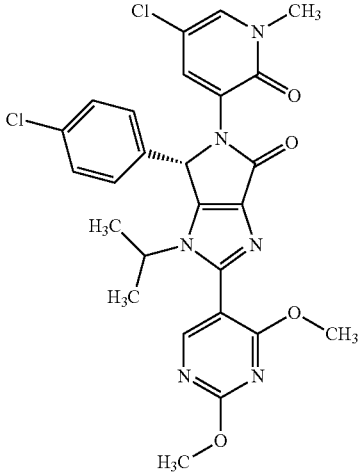 [SMILES: COc1ncc(-c2nc3c(n2C(C)C)[C@H](c2ccc(Cl)cc2)N(c2cc(Cl)cn(C)c2=O)C3=O)c(OC)n1] | WO 2013/111105 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A15 | | 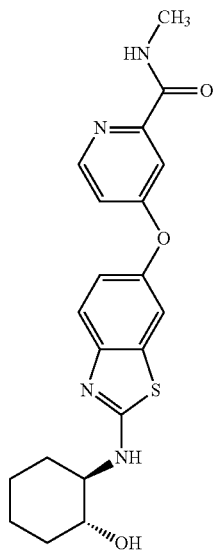 [SMILES: CNC(=O)c1cc(Oc2ccc3nc(N[C@@H]4CCCC[C@H]4O)sc3c2)ccn1] | WO2007/121484 |
| A16 | Imatinib mesylate GLEEVEC ® | 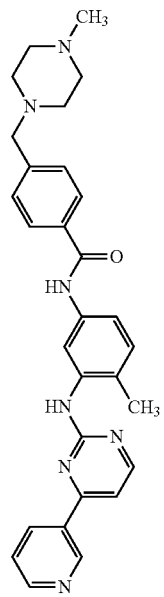Mesylate | WO 1999/003854 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A17 | | 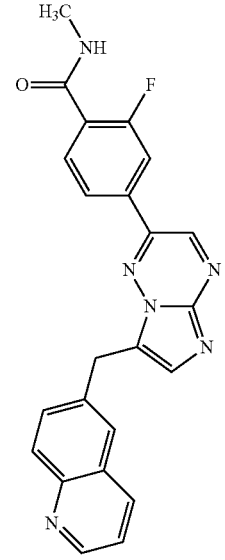<br>Dihydrochloric salt | EP 2099447<br>U.S. Pat. No. 7,767,675<br>U.S. Pat. No. 8,420,645 |
| A18 | Ruxolitinib Phosphate<br>JAKAFI ® | 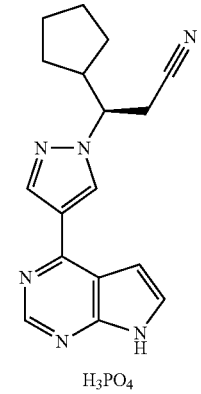<br>H₃PO₄ | WO 2007/070514<br>EP 2474545<br>U.S. Pat. No. 7,598,257<br>WO 2014/018632 |
| A19 | Panobinostat | 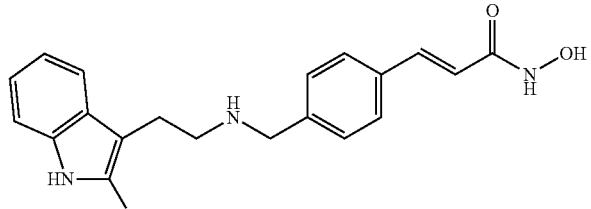 | WO 2014/072493<br>WO 2002/022577<br>EP 1870399 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A20 | Osilodrostat | 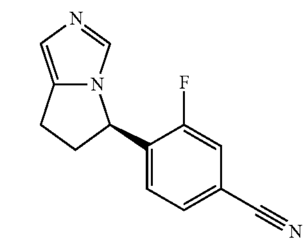 [SMILES: N#Cc1ccc([C@H]2CCc3cncn32)c(F)c1] | WO 2007/024945 |
| A21 | | 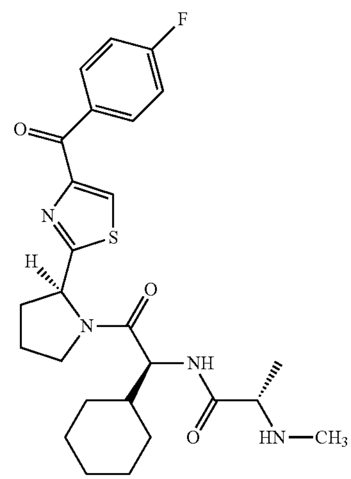 [SMILES: CN[C@@H](C)C(=O)N[C@H](C(=O)N1CCC[C@H]1c1nc(C(=O)c2ccc(F)cc2)cs1)C1CCCCC1] | WO 2008/016893<br>EP 2051990<br>U.S. Pat. No. 8,546,336 |
| A23 | ceritinib<br>ZYKADIA ™ | 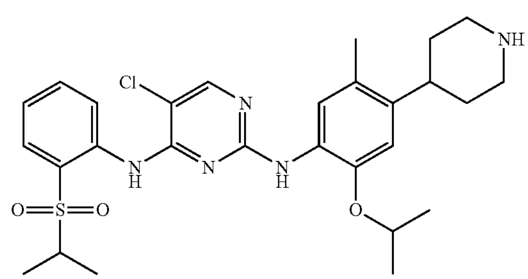 [SMILES: Cc1cc(Nc2ncc(Cl)c(Nc3ccccc3S(=O)(=O)C(C)C)n2)c(OC(C)C)cc1C1CCNCC1] | WO 2008/073687<br>U.S. Pat. No. 8,039,479 |
| A24 | Ribociclib<br>KISQALI ® | 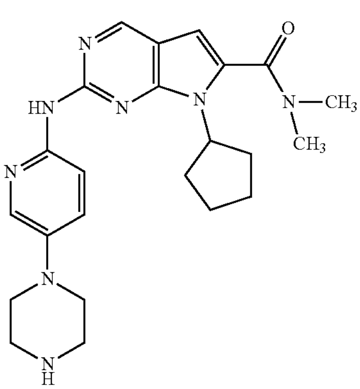 [SMILES: CN(C)C(=O)c1cc2cnc(Nc3ccc(N4CCNCC4)cn3)nc2n1C1CCCC1] | U.S. Pat. No. 8,415,355<br>U.S. Pat. No. 8,685,980 |

TABLE 16-continued

*Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.*

| Compound Designation | Generic Name Tradename | Compound Structure | Patents/Patent Application Publications |
|---|---|---|---|
| A25 | | (structure) | WO 2010/007120 |
| A26 | | Human monoclonal antibody to PRLR | U.S. Pat. No. 7,867,493 |
| A27 | | (structure) | WO 2010/026124<br>EP 2344474<br>US 2010/0056576<br>WO2008/106692 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A28 | | [chemical structure] | WO 2010/101849 |
| A30 | | [chemical structure] | WO 2011/101409 |
| A31 | | Human monoclonal antibody to HER3 | WO 2012/022814<br>EP 2606070<br>U.S. Pat. No. 8,735,551 |
| A32 | | Antibody Drug Conjugate (ADC) | WO 2014/160160<br>Ab: 12425 (see Table 1, paragraph [00191])<br>Linker: SMCC (see paragraph [00117]<br>Payload: DM1 (see paragraph [00111]<br>See also Claim 29 |
| A33 | | Monoclonal antibody or Fab to M-CSF | WO 2004/045532 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A35 | Midostaurin | 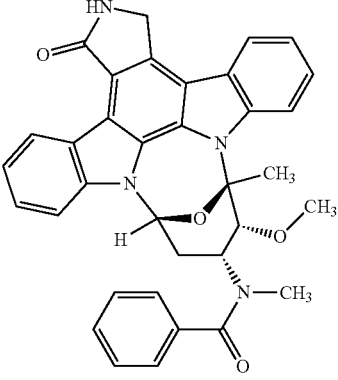 [SMILES: CO[C@@H]1[C@H](N(C)C(=O)c2ccccc2)C[C@H]2O[C@]1(C)n1c3ccccc3c3c4c(c5c6ccccc6n2c5c31)C(=O)NC4] | WO 2003/037347<br>EP 1441737<br>US 2012/252785 |
| A36 | Everolimus<br>AFINITOR ® | 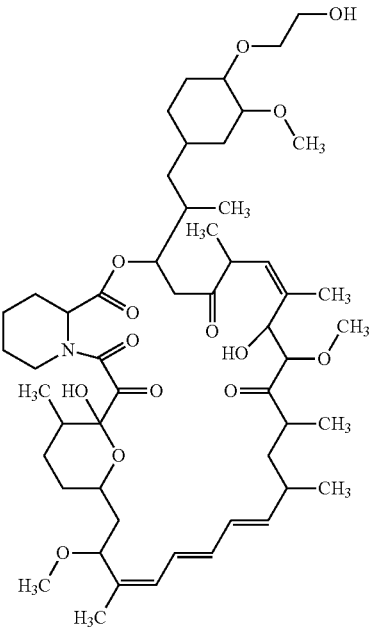 [SMILES: COC1CC2CCC(C)C(O)(O2)C(=O)C(=O)N2CCCCC2C(=O)OC(C(C)CC2CCC(OCCO)C(OC)C2)CC(=O)C(C)/C=C(/C)C(O)C(OC)C(=O)C(C)CC(C)/C=C/C=C/C=C\1C] | WO 1994/009010<br>WO 2014/085318 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A37 | | 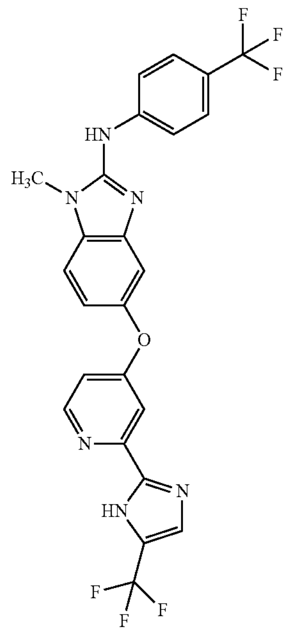 [SMILES: Cn1c(Nc2ccc(C(F)(F)F)cc2)nc2cc(Oc3ccnc(-c4ncc(C(F)(F)F)[nH]4)c3)ccc21] | WO 2007/030377<br>U.S. Pat. No. 7,482,367 |
| A38 | Pasireotide diaspartate SIGNIFOR ® | 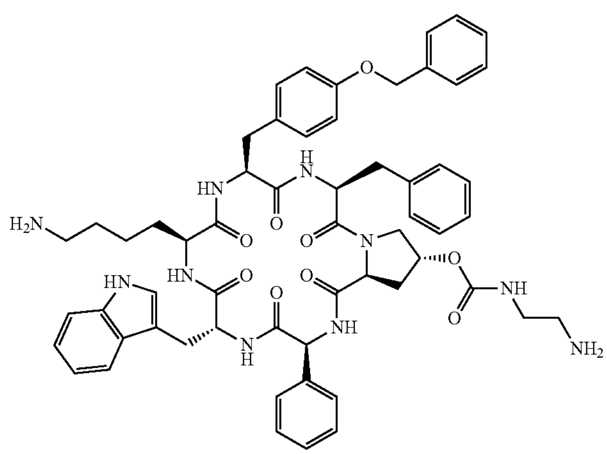 [SMILES: NCCCC[C@@H]1NC(=O)[C@@H](Cc2c[nH]c3ccccc23)NC(=O)[C@H](c2ccccc2)NC(=O)[C@@H]2C[C@@H](OC(=O)NCCN)CN2C(=O)[C@H](Cc2ccccc2)NC(=O)[C@H](Cc2ccc(OCc3ccccc3)cc2)NC1=O] | WO2002/010192<br>U.S. Pat. No. 7,473,761 |
| A40 | | 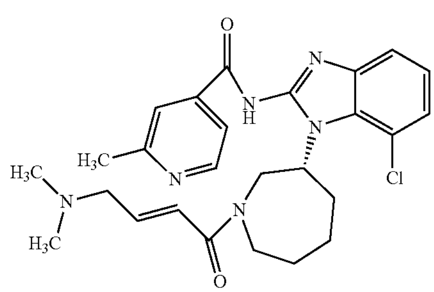 [SMILES: Cc1cc(C(=O)Nc2nc3cccc(Cl)c3n2[C@@H]2CCCCN(C(=O)/C=C/CN(C)C)C2)ccn1] | WO 2013/184757 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A41 | | 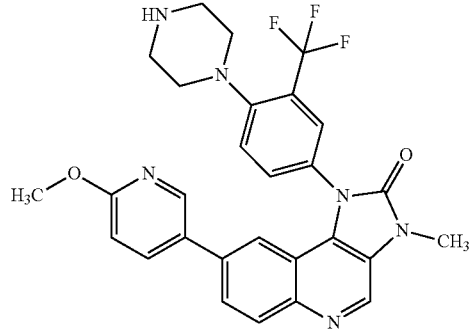 | WO 2006/122806 |
| A42 | | 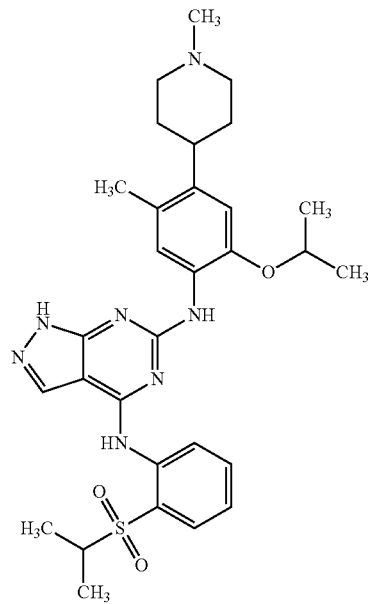 [SMILES: Cc1cc(Nc2nc(Nc3ccccc3S(=O)(=O)C(C)C)c3cn[nH]c3n2)c(OC(C)C)cc1C1CCN(C)CC1] | WO 2008/073687<br>U.S. Pat. No. 8,372,858 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A43 | | 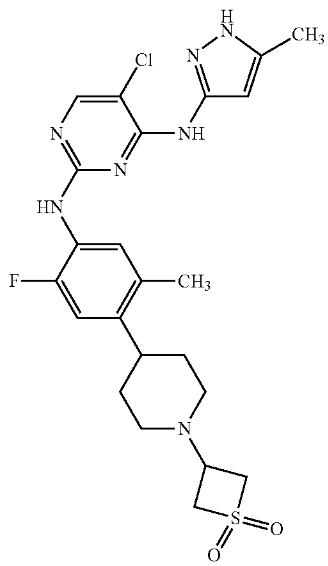 [SMILES: Cc1cc(Nc2nc(Nc3cc(C)c(C4CCN(C5CS(=O)(=O)C5)CC4)cc3F)ncc2Cl)n[nH]1] | WO 2010/002655 U.S. Pat. No. 8,519,129 |
| A44 | | 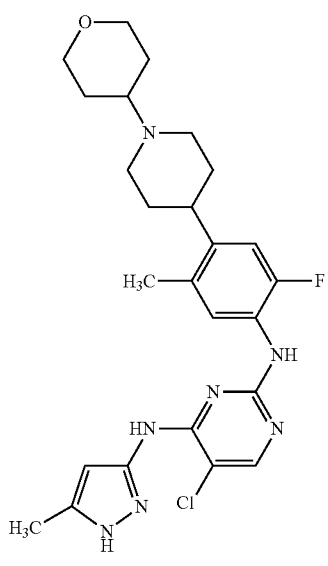 [SMILES: Cc1cc(Nc2nc(Nc3cc(C)c(C4CCN(C5CCOCC5)CC4)cc3F)ncc2Cl)n[nH]1] | WO 2010/002655 U.S. Pat. No. 8,519,129 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A45 | | 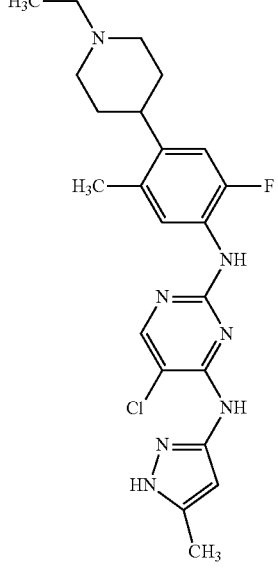 | WO 2010/002655 |
| A46 | Valspodar AMDRAY ™ | 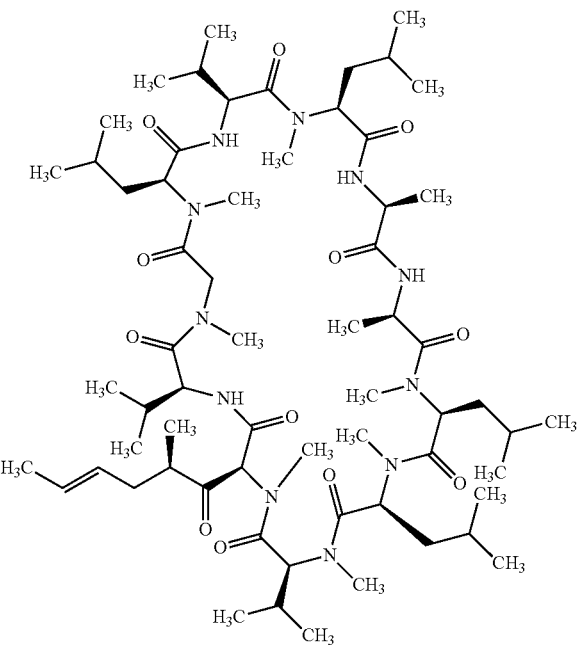 [SMILES: C/C=C/C[C@@H](C)C(=O)[C@H]1C(=O)N[C@@H](C(C)C)C(=O)N(C)CC(=O)N(C)[C@@H](CC(C)C)C(=O)N[C@@H](C(C)C)C(=O)N(C)[C@@H](CC(C)C)C(=O)N[C@@H](C)C(=O)N[C@H](C)C(=O)N(C)[C@@H](CC(C)C)C(=O)N(C)[C@@H](CC(C)C)C(=O)N(C)[C@@H](C(C)C)C(=O)N1C] | EP 296122 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A47 | Vatalanib succinate | 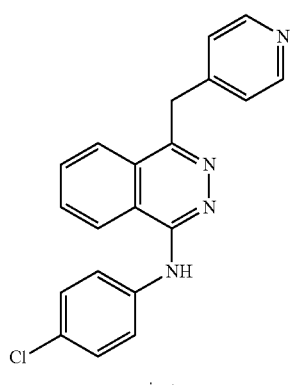<br>succinate | WO 98/35958 |
| A48 | | IDH inhibitor | WO2014/141104 |
| A49 | Asciminib | 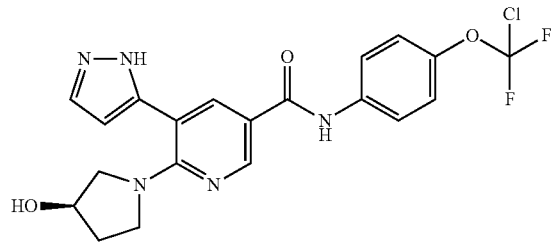<br>BCR-ABL inhibitor | WO2013/171639<br>WO2013/171640<br>WO2013/171641<br>WO2013/171642 |
| A50 | | cRAF inhibitor | WO2014/151616 |
| A51 | | ERK1/2 ATP competitive inhibitor | WO2015/066188 |
| A52 | | or a choline salt thereof | WO2010/015613<br>WO2013030803<br>U.S. Pat. No. 7,989,497 |
| A53 | | 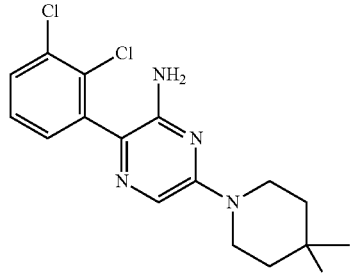 | WO2015/107493 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A54 | | 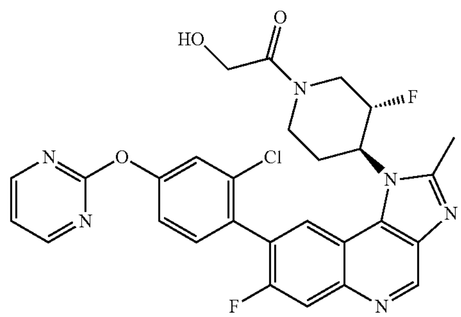 [SMILES: Cc1nc2cnc3cc(F)c(-c4ccc(Oc5ncccn5)cc4Cl)cc3c2n1[C@H]1CCN(C(=O)CO)C[C@@H]1F] | WO2015/022662 |
| A55 | | 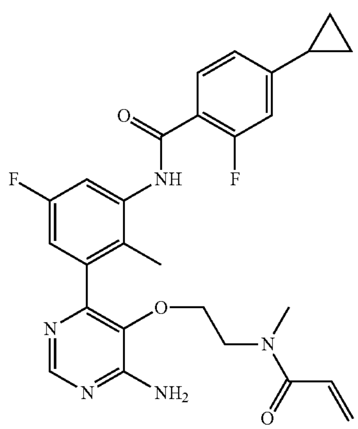 [SMILES: C=CC(=O)N(C)CCOc1c(N)ncnc1-c1cc(F)cc(NC(=O)c2ccc(C3CC3)cc2F)c1C] | U.S. Pat. No. 9,512,084 WO/2015/079417 |
| A56 | | 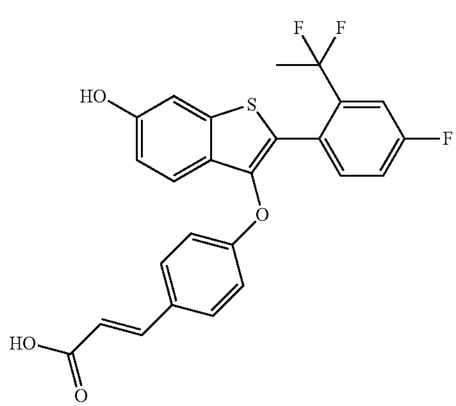 [SMILES: CC(F)(F)c1cc(F)ccc1-c1sc2cc(O)ccc2c1Oc1ccc(/C=C/C(=O)O)cc1] | WO2014/130310 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A57 | trametinib | 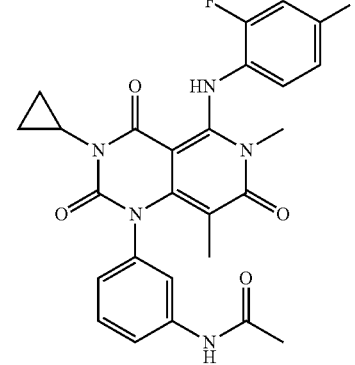 | WO2005/121142 U.S. Pat. No. 7,378,423 |
| A58 | dabrafenib | 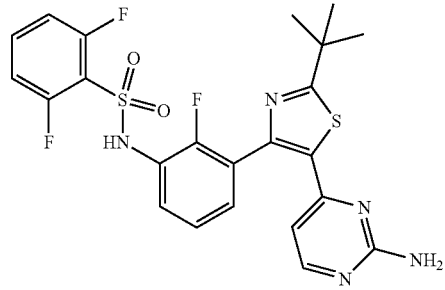 [SMILES: CC(C)(C)c1nc(-c2cccc(NS(=O)(=O)c3c(F)cccc3F)c2F)c(-c2ccnc(N)n2)s1] | WO 2009/137391 U.S. Pat. No. 7,994,185 |
| A59 | | 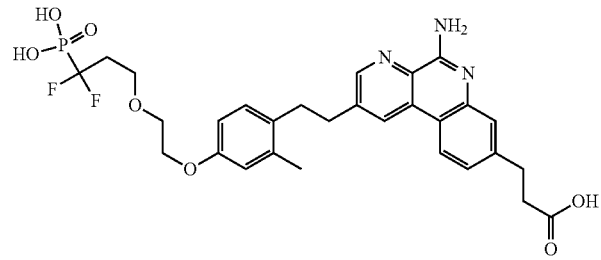 [SMILES: Cc1cc(OCCOCCC(F)(F)P(=O)(O)O)ccc1CCc1cnc2c(N)nc3cc(CCC(=O)O)ccc3c2c1] | WO2011/049677 |
| A60 | | 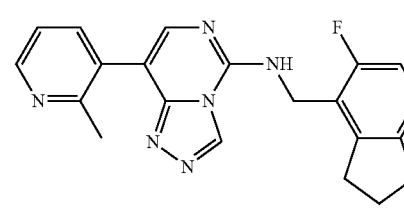 | WO 2016/103155 U.S. Pat. No. 9,580,437 EP 3237418 |

TABLE 16-continued

Selected therapeutic agents that can be administered in combination with the anti-human ENTPD2 antibody molecules, e.g., as a single agent or in combination with other immunomodulators described herein. Each publication listed in this Table is herein incorporated by reference in its entirety, including all structural formulae therein.

| Compound Designation | Generic Name Tradename | Compound Structure | Patents/Patent Application Publications |
|---|---|---|---|
| A61 | octreotide | 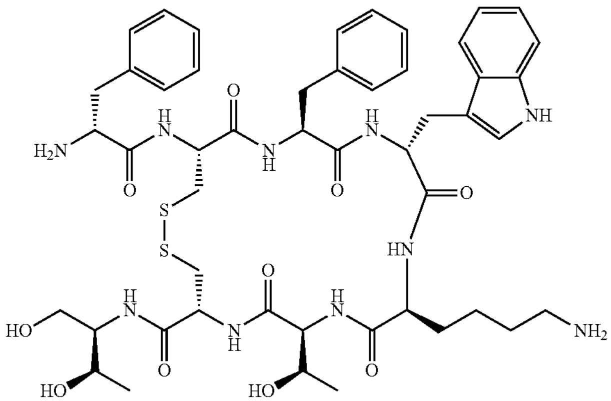 [SMILES: C[C@@H](O)[C@@H]1NC(=O)[C@H](CCCCN)NC(=O)[C@@H](Cc2c[nH]c3ccccc23)NC(=O)[C@H](Cc2ccccc2)NC(=O)[C@@H](NC(=O)[C@H](N)Cc2ccccc2)CSSC[C@@H](C(=O)N[C@H](CO)[C@@H](C)O)NC1=O] | U.S. Pat. No. 4,395,403<br>EP 0 029 579 |

The anti-human ENTPD2 antibody molecules as described herein can be administered in combination with an additional therapeutic agent. In some embodiments, the additional therapeutic agent is chosen from one or more of: 1) a protein kinase C (PKC) inhibitor; 2) a heat shock protein 90 (HSP90) inhibitor; 3) an inhibitor of a phosphoinositide 3-kinase (PI3K) and/or target of rapamycin (mTOR); 4) an inhibitor of cytochrome P450 (e.g., a CYP17 inhibitor or a 17alpha-Hydroxylase/C17-20 Lyase inhibitor); 5) an iron chelating agent; 6) an aromatase inhibitor; 7) an inhibitor of p53, e.g., an inhibitor of a p53/Mdm2 interaction; 8) an apoptosis inducer; 9) an angiogenesis inhibitor; 10) an aldosterone synthase inhibitor; 11) a smoothened (SMO) receptor inhibitor; 12) a prolactin receptor (PRLR) inhibitor; 13) a Wnt signaling inhibitor; 14) a CDK4/6 inhibitor; 15) a fibroblast growth factor receptor 2 (FGFR2)/fibroblast growth factor receptor 4 (FGFR4) inhibitor; 16) an inhibitor of macrophage colony-stimulating factor (M-CSF); 17) an inhibitor of one or more of histamine release, Flt3 (e.g., FLK2/STK1) or PKC; 18) an inhibitor of one or more of VEGFR-2 (e.g., FLK-1/KDR), PDGFRbeta, c-KIT or Raf kinase C; 19) a somatostatin agonist and/or a growth hormone release inhibitor; 20) an anaplastic lymphoma kinase (ALK) inhibitor; 21) an insulin-like growth factor 1 receptor (IGF-1R) inhibitor; 22) a P-Glycoprotein 1 inhibitor; 23) a vascular endothelial growth factor receptor (VEGFR) inhibitor; 24) a BCR-ABL kinase inhibitor; 25) an FGFR inhibitor; 26) an inhibitor of CYP11B2; 27) a HDM2 inhibitor, e.g., an inhibitor of the HDM2-p53 interaction; 28) an inhibitor of a tyrosine kinase; 29) an inhibitor of c-MET; 30) an inhibitor of JAK; 31) an inhibitor of DAC; 32) an inhibitor of 11β-hydroxylase; 33) an inhibitor of IAP; 34) an inhibitor of PIM kinase; 35) an inhibitor of Porcupine; 36) an inhibitor of BRAF, e.g., BRAF V600E or wild-type BRAF; 37) an inhibitor of HERS; 38) an inhibitor of MEK; or 39) an inhibitor of a lipid kinase, e.g., as described herein and in Table 1.

In one embodiment, the combination, e.g., a combination comprising an anti-human ENTPD2 antibody molecule as described herein, includes or is used in combination with a PKC inhibitor, Sotrastaurin (Compound A1), or a compound disclosed in PCT Publication No. WO 2005/039549, to treat a disorder, e.g., a disorder described herein. In one embodiment, the PKC inhibitor is Sotrastaurin (Compound A1) or a compound disclosed in PCT Publication No. WO 2005/039549.

In one embodiment, the combination, e.g., a combination comprising an anti-human ENTPD2 antibody molecule as described herein, includes or is used in combination with a BCR-ABL inhibitor, nilotinib (Compound A2, Tasigna®), or a compound disclosed in PCT Publication No. WO 2004/005281, to treat a disorder, e.g., a disorder described herein. In one embodiment, the BCR-ABL inhibitor is nilotinib, or a compound disclosed in PCT Publication No. WO 2004/005281.

In another embodiment, the combination, e.g., a combination comprising an anti-human ENTPD2 antibody molecule as described herein, includes or is used in combination with an HSP90 inhibitor, to treat a disorder, e.g., a disorder described herein, e.g., a cancer.

In another embodiment, the combination, e.g., a combination comprising an anti-human ENTPD2 antibody molecule as described herein, is used in combination with an inhibitor of PI3K and/or mTOR, 8-(6-Methoxy-pyridin-3-yl)-3-methyl-1-(4-piperazin-1-yl-3-trifluoromethyl-phenyl)-1,3-dihydro-imidazo[4,5-c]quinolin-2-one (Compound A41), to treat a disorder, e.g., a disorder described herein. In one embodiment, the PI3K and/or mTOR inhibitor is 8-(6-Methoxy-pyridin-3-yl)-3-methyl-1-(4-piperazin-1-yl-3-trifluoromethyl-phenyl)-1,3-dihydro-imidazo[4,5-c]quinolin-2-one (Compound A41).

In another embodiment, the combination, e.g., a combination comprising an anti-human ENTPD2 antibody molecule as described herein, includes or is used in combination with an FGFR inhibitor, 3-(2,6-dichloro-3,5-dimethoxyphenyl)-1-(6-((4-(4-ethylpiperazin-1-yl)phenyl)amino)pyrimidin-4-yl)-1-methylurea (Compound A5) or a compound disclosed in U.S. Pat. No. 8,552,002, to treat a disorder, e.g., a disorder described herein. In one embodiment, the FGFR inhibitor is 3-(2,6-dichloro-3,5-dimethoxyphenyl)-1-(6-((4-(4-ethylpiperazin-1-yl)phenyl)amino)pyrimidin-4-yl)-1-methylurea (Compound A5) or a compound disclosed in U.S. Pat. No. 8,552,002. Compound A5 has the following structure:

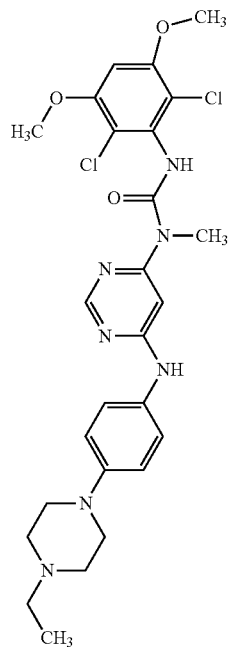 [SMILES: CCN1CCN(c2ccc(Nc3cc(N(C)C(=O)Nc4c(Cl)c(OC)cc(OC)c4Cl)ncn3)cc2)CC1]

In another embodiment, the combination, e.g., a combination comprising an anti-human ENTPD2 antibody molecule as described herein, includes or is used in combination with a PI3K inhibitor, Buparlisib (Compound A6), or a compound disclosed in PCT Publication No. WO 2007/084786, to treat a disorder, e.g., a disorder described herein. In one embodiment, the PI3K inhibitor is Buparlisib (Compound A6) or a compound disclosed in PCT Publication No. WO 2007/084786. Compound A6 has the following structure:

a.

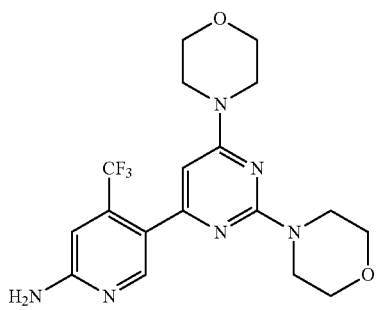 [SMILES: Nc1cc(C(F)(F)F)c(-c2cc(N3CCOCC3)nc(N3CCOCC3)n2)cn1]

In another embodiment, the combination, e.g., a combination comprising an anti-human ENTPD2 antibody molecule as described herein, includes or is used in combination with an FGFR inhibitor, 8-(2,6-difluoro-3,5-dimethoxyphenyl)-N-(4-((dimethylamino)methyl)-1H-imidazol-2-yl)quinoxaline-5-carboxamide (Compound A7) or a compound disclosed in PCT Publication No. WO 2009/141386 to treat a disorder, e.g., a disorder described herein. In one embodiment, the FGFR inhibitor is 8-(2,6-difluoro-3,5-dimethoxyphenyl)-N-(4-((dimethylamino)methyl)-1H-imidazol-2-yl)quinoxaline-5-carboxamide (Compound A7) or a compound disclosed in a PCT Publication No. WO 2009/141386.

In another embodiment the combination, e.g., a combination comprising an anti-human ENTPD2 antibody molecule as described herein, includes or is used in combination with a PI3K inhibitor, (S)—N1-(4-methyl-5-(2-(1,1,1-trifluoro-2-methylpropan-2-yl)pyridin-4-yl)thiazol-2-yl)pyrrolidine-1,2-dicarboxamide (Compound A8) or a compound disclosed PCT Publication No. WO 2010/029082 to treat a disorder, e.g., a disorder described herein. In one embodiment, the PI3K inhibitor is (S)—N1-(4-methyl-5-(2-(1,1,1-trifluoro-2-methylpropan-2-yl)pyridin-4-yl)thiazol-2-yl)pyrrolidine-1,2-dicarboxamide (Compound A8) or a compound disclosed PCT Publication No. WO 2010/029082.

In another embodiment, the combination, e.g., a combination comprising an anti-human ENTPD2 antibody molecule as described herein, includes or is used in combination with an inhibitor of cytochrome P450 (e.g., a CYP17 inhibitor) or a compound disclosed in PCT Publication No. WO 2010/149755, to treat a disorder, e.g., a disorder described herein. In one embodiment, the cytochrome P450 inhibitor (e.g., the CYP17 inhibitor) is a compound disclosed in PCT Publication No. WO 2010/149755; U.S. Pat. No. 8,263,635 B2; or EP 2445903 B1.

In another embodiment, the combination, e.g., a combination comprising an anti-human ENTPD2 antibody molecule as described herein, includes or is used in combination with an HDM2 inhibitor, (S)-1-(4-chlorophenyl)-7-isopropoxy-6-methoxy-2-(4-(methyl(((1r,4S)-4-(4-methyl-3-oxopiperazin-1-yl)cyclohexyl)methyl)amino)phenyl)-1,2-dihydroisoquinolin-3(4H)-one (Compound A10) or a compound disclosed in PCT Publication No. WO 2011/076786 to treat a disorder, e.g., a disorder described herein). In one embodiment, the HDM2 inhibitor is (S)-1-(4-chlorophenyl)-7-isopropoxy-6-methoxy-2-(4-(methyl(((1r,4S)-4-(4-methyl-3-oxopiperazin-1-yl)cyclohexyl)methyl)amino)phenyl)-1,2-dihydroisoquinolin-3(4H)-one (Compound A10) or a compound disclosed in PCT Publication No. WO 2011/076786.

In another embodiment, the combination, e.g., a combination comprising an anti-human ENTPD2 antibody molecule as described herein, includes or is used in combination with an iron chelating agent, Deferasirox (also known as EXJADE; Compound A11), or a compound disclosed in PCT Publication No. WO 1997/049395 to treat a disorder, e.g., a disorder described herein. In one embodiment, the iron chelating agent is Deferasirox or a compound disclosed in PCT Publication No. WO 1997/049395. In one embodiment, the iron chelating agent is Deferasirox (Compound A11).

In another embodiment, the combination, e.g., a combination comprising an anti-human ENTPD2 antibody molecule as described herein, includes or is used in combination with an aromatase inhibitor, Letrozole (also known as FEMARA; Compound A12), or a compound disclosed in U.S. Pat. No. 4,978,672 to treat a disorder, e.g., a disorder described herein. In one embodiment, the aromatase inhibitor is Letrozole (Compound A12) or a compound disclosed in U.S. Pat. No. 4,978,672.

In another embodiment, the combination, e.g., a combination comprising an anti-human ENTPD2 antibody molecule as described herein, includes or is used in combination with a PI3K inhibitor, e.g., a pan-PI3K inhibitor, (4S,5R)-

3-(2'-amino-2-morpholino-4'-(trifluoromethyl)-[4,5'-bipyrimidin]-6-yl)-4-(hydroxymethyl)-5-methyloxazolidin-2-one (Compound A13) or a compound disclosed in PCT Publication No. WO2013/124826 to treat a disorder, e.g., a disorder described herein. In one embodiment, the PI3K inhibitor is (4S,5R)-3-(2'-amino-2-morpholino-4'-(trifluoromethyl)-[4,5'-bipyrimidin]-6-yl)-4-(hydroxymethyl)-5-methyloxazolidin-2-one (Compound A13) or a compound disclosed in PCT Publication No. WO2013/124826.

In another embodiment, the combination, e.g., a combination comprising an anti-human ENTPD2 antibody molecule as described herein, includes or is used in combination with an inhibitor of p53 and/or a p53/Mdm2 interaction, (S)-5-(5-chloro-1-methyl-2-oxo-1,2-dihydropyridin-3-yl)-6-(4-chlorophenyl)-2-(2,4-dimethoxypyrimidin-5-yl)-1-isopropyl-5,6-dihydropyrrolo[3,4-d]imidazol-4(1H)-one (Compound A14), or a compound disclosed in PCT Publication No. WO2013/111105 to treat a disorder, e.g., a disorder described herein. In one embodiment, the p53 and/or a p53/Mdm2 interaction inhibitor is (S)-5-(5-chloro-1-methyl-2-oxo-1,2-dihydropyridin-3-yl)-6-(4-chlorophenyl)-2-(2,4-dimethoxypyrimidin-5-yl)-1-isopropyl-5,6-dihydropyrrolo[3,4-d]imidazol-4(1H)-one (Compound A14) or a compound disclosed in PCT Publication No. WO2013/111105.

In another embodiment, the combination, e.g., a combination comprising an anti-human ENTPD2 antibody molecule as described herein, includes or is used in combination with a CSF-1R tyrosine kinase inhibitor, 4-((2-(((1R,2R)-2-hydroxycyclohexyl)amino)benzo[d]thiazol-6-yl)oxy)-N-methylpicolinamide (Compound A15), or a compound disclosed in PCT Publication No. WO 2005/073224 to treat a disorder, e.g., a disorder described herein. In one embodiment, the CSF-1R tyrosine kinase inhibitor is 4-((2-(((1R,2R)-2-hydroxycyclohexyl)amino)benzo[d]thiazol-6-yl)oxy)-N-methylpicolinamide (Compound A15) or a compound disclosed in PCT Publication No. WO 2005/073224.

In another embodiment, the combination, e.g., a combination comprising an anti-human ENTPD2 antibody molecule as described herein, includes or is used in combination with an apoptosis inducer and/or an angiogenesis inhibitor, such as Imatinib mesylate (also known as GLEEVEC®; Compound A16) or a compound disclosed in PCT Publication No. WO1999/003854 to treat a disorder, e.g., a disorder described. In one embodiment, the apoptosis inducer and/or an angiogenesis inhibitor is Imatinib mesylate (Compound A16) or a compound disclosed in PCT Publication No. WO1999/003854.

In another embodiment, the combination, e.g., a combination comprising an anti-human ENTPD2 antibody molecule as described herein, includes or is used in combination with a JAK inhibitor, 2-fluoro-N-methyl-4-(7-(quinolin-6-ylmethyl)imidazo[1,2-b][1,2,4]triazin-2-yl)benzamide (Compound A17), or a dihydrochloric salt thereof, or a compound disclosed in PCT Publication No. WO 2007/070514, to treat a disorder, e.g., a disorder described herein. In one embodiment, the JAK inhibitor is 2-fluoro-N-methyl-4-(7-(quinolin-6-ylmethyl)imidazo[1,2-b][1,2,4]triazin-2-yl)benzamide (Compound A17), or a dihydrochloric salt thereof, or a compound disclosed in PCT Publication No. WO 2007/070514.

In another embodiment, the combination, e.g., a combination comprising an anti-human ENTPD2 antibody molecule as described herein, includes or is used in combination with a JAK inhibitor, Ruxolitinib Phosphate (also known as JAKAFI; Compound A18) or a compound disclosed in PCT Publication No. WO 2007/070514 to treat a disorder, e.g., a disorder described herein. In one embodiment, the JAK inhibitor is Ruxolitinib Phosphate (Compound A18) or a compound disclosed in PCT Publication No. WO 2007/070514.

In another embodiment, the combination, e.g., a combination comprising an anti-human ENTPD2 antibody molecule as described herein, includes or is used in combination with a deacetylase (DAC) inhibitor, Panobinostat (Compound A19), or a compound disclosed in PCT Publication No. WO 2014/072493 to treat a disorder, e.g., a disorder described herein. In one embodiment, the DAC inhibitor is Panobinostat (Compound A19) or a compound disclosed in PCT Publication No. WO 2014/072493.

In another embodiment, the combination, e.g., a combination comprising an anti-human ENTPD2 antibody molecule as described herein, includes or is used in combination with an inhibitor of one or more of cytochrome P450 (e.g., 11B2), aldosterone or angiogenesis, Osilodrostat (Compound A20), or a compound disclosed in PCT Publication No. WO2007/024945 to treat a disorder, e.g., a disorder described herein.

In another embodiment, the combination, e.g., a combination comprising an anti-human ENTPD2 antibody molecule as described herein, includes or is used in combination with a IAP inhibitor, (S)—N—((S)-1-cyclohexyl-2-((S)-2-(4-(4-fluorobenzoyl)thiazol-2-yl)pyrrolidin-1-yl)-2-oxoethyl)-2-(methylamino)propanamide (Compound A21) or a compound disclosed in U.S. Pat. No. 8,552,003 to treat a disorder, e.g., a disorder described herein. In one embodiment, the IAP inhibitor is (S)—N—((S)-1-cyclohexyl-2-((S)-2-(4-(4-fluorobenzoyl)thiazol-2-yl)pyrrolidin-1-yl)-2-oxoethyl)-2-(methylamino)propanamide (Compound A21) or a compound disclosed in U.S. Pat. No. 8,552,003.

In another embodiment, the combination, e.g., a combination comprising an anti-human ENTPD2 antibody molecule as described herein, includes or is used in combination a Smoothened (SMO) inhibitor, (R)-2-(5-(4-(6-benzyl-4,5-dimethylpyridazin-3-yl)-2-methylpiperazin-1-yl)pyrazin-2-yl)propan-2-ol (Compound A25), or a compound disclosed in PCT Publication No. WO 2010/007120 to treat a disorder, e.g., a disorder described herein. In one embodiment, the SMO inhibitor is (R)-2-(5-(4-(6-benzyl-4,5-dimethylpyridazin-3-yl)-2-methylpiperazin-1-yl)pyrazin-2-yl)propan-2-ol (Compound A25), or a compound disclosed in PCT Publication No. WO 2010/007120.

In another embodiment, the combination, e.g., a combination comprising an anti-human ENTPD2 antibody molecule as described herein, includes or is used in combination with an Alk inhibitor, ceritinib (also known as ZYKADIA; Compound A23) to treat a disorder, e.g., a disorder described herein.

In another embodiment, the combination, e.g., a combination comprising an anti-human ENTPD2 antibody molecule as described herein, includes or is used in combination with a JAK and/or CDK4/6 inhibitor, 7-cyclopentyl-N,N-dimethyl-2-((5-(piperazin-1-yl)pyridin-2-yl)amino)-7H-pyrrolo[2,3-d]pyrimidine-6-carboxamide (Compound A24), or a compound disclosed in U.S. Pat. No. 8,415,355 or 8,685,980 to treat a disorder, e.g., a disorder described herein. In one embodiment, the JAK and/or CDK4/6 inhibitor is 7-cyclopentyl-N,N-dimethyl-2-((5-(piperazin-1-yl)pyridin-2-yl)amino)-7H-pyrrolo[2,3-d]pyrimidine-6-carboxamide (Compound A24) or a compound disclosed in U.S. Pat. No. 8,415,355 or 8,685,980.

In another embodiment, the combination, e.g., a combination comprising an anti-human ENTPD2 antibody molecule as described herein, includes or is used in combination a prolactin receptor (PRLR) inhibitor, a human monoclonal antibody molecule (Compound A26) as disclosed in U.S. Pat. No. 7,867,493), to treat a disorder, e.g., a disorder described herein.

In another embodiment, the combination, e.g., a combination comprising an anti-human ENTPD2 antibody molecule as described herein, includes or is used in combination with a PIM Kinase inhibitor, N-(4-((1R,3S,5S)-3-amino-5-methylcyclohexyl)pyridin-3-yl)-6-(2,6-difluorophenyl)-5-fluoropicolinamide (Compound A27) or a compound disclosed in PCT Publication No. WO 2010/026124 to treat a disorder, e.g., a disorder described herein. In one embodiment, the PIM Kinase inhibitor is N-(4-((1R,3S,5S)-3-amino-5-methylcyclohexyl)pyridin-3-yl)-6-(2,6-difluorophenyl)-5-fluoropicolinamide (Compound A27) or a compound disclosed in PCT Publication No. WO 2010/026124.

In another embodiment, the combination, e.g., a combination comprising an anti-human ENTPD2 antibody molecule as described herein, includes or is used in combination a Wnt signaling inhibitor, 2-(2',3-dimethyl-[2,4'-bipyridin]-5-yl)-N-(5-(pyrazin-2-yl)pyridin-2-yl)acetamide (Compound A28) or a compound disclosed in PCT publication No. WO 2010/101849 to treat a disorder, e.g., a disorder described herein. In one embodiment, the Wnt signaling inhibitor is 2-(2',3-dimethyl-[2,4'-bipyridin]-5-yl)-N-(5-(pyrazin-2-yl)pyridin-2-yl)acetamide (Compound A28) or a compound disclosed in PCT publication No. WO 2010/101849. In one embodiment, the Wnt signaling inhibitor is 2-(2',3-dimethyl-[2,4'-bipyridin]-5-yl)-N-(5-(pyrazin-2-yl)pyridin-2-yl)acetamide (Compound A28).

In another embodiment, the combination, e.g., a combination comprising an anti-human ENTPD2 antibody molecule as described herein, includes or is used in combination with a BRAF inhibitor, to treat a disorder, e.g., a disorder described herein, e.g., a cancer.

In another embodiment, the combination, e.g., a combination comprising an anti-human ENTPD2 antibody molecule as described herein, includes or is used in combination a CDK4/6 inhibitor, 7-cyclopentyl-N,N-dimethyl-2-((5-((1R,6S)-9-methyl-4-oxo-3,9-diazabicyclo[4.2.1]nonan-3-yl)pyridin-2-yl)amino)-7H-pyrrolo[2,3-d]pyrimidine-6-carboxamide (Compound A30), or a compound disclosed in PCT publication No. WO 2011/101409 to treat a disorder, e.g., a disorder described herein. In one embodiment, the CDK4/6 inhibitor is 7-cyclopentyl-N,N-dimethyl-2-((5-((1R,6S)-9-methyl-4-oxo-3,9-diazabicyclo[4.2.1]nonan-3-yl)pyridin-2-yl)amino)-7H-pyrrolo[2,3-d]pyrimidine-6-carboxamide (Compound A30) or a compound disclosed in PCT publication No. WO 2011/101409.

In another embodiment, the combination, e.g., a combination comprising an anti-human ENTPD2 antibody molecule as described herein, includes or is used in combination with a HER3 inhibitor, Compound A31, or a compound disclosed in PCT Publication No. WO 2012/022814, to treat a disorder, e.g., a disorder described herein. In one embodiment, the HER3 inhibitor is Compound A31 or a compound disclosed in PCT Publication WO 2012/022814.

In another embodiment, the combination, e.g., a combination comprising an anti-human ENTPD2 antibody molecule as described herein, includes or is used in combination an FGFR2 and/or FGFR4 inhibitor, Compound A32, or a compound disclosed in a publication PCT Publication No. WO 2014/160160 (e.g., an antibody molecule drug conjugate against an FGFR2 and/or FGFR4, e.g., mAb 12425), to treat a disorder, e.g., a disorder described herein. In some embodiments, Compound A32 is an antibody molecule drug conjugate against an FGFR2 and/or FGFR4, e.g., mAb 12425.

In another embodiment, the combination, e.g., a combination comprising an anti-human ENTPD2 antibody molecule as described herein, includes or is used in combination an M-CSF inhibitor, Compound A33, or a compound disclosed in PCT Publication No. WO 2004/045532 (e.g., an antibody molecule or Fab fragment against M-CSF), to treat a disorder, e.g., a disorder described herein.

In another embodiment, the combination, e.g., a combination comprising an anti-human ENTPD2 antibody molecule as described herein, includes or is used in combination with a MEK inhibitor, to treat a disorder, e.g., a cancer as described herein.

In another embodiment, the combination, e.g., a combination comprising an anti-human ENTPD2 antibody molecule as described herein, includes or is used in combination an inhibitor of one or more of c-KIT, histamine release, Flt3 (e.g., FLK2/STK1) or PKC, Midostaurin (Compound A35) or a compound disclosed in PCT Publication No. WO 2003/037347 to treat a disorder, e.g., a disorder described herein. In one embodiment, the inhibitor is Midostaurin (Compound A35) or compound disclosed in PCT Publication No. WO 2003/037347.

In another embodiment, the combination, e.g., a combination comprising an anti-human ENTPD2 antibody molecule as described herein, includes or is used in combination an inhibitor of one or more of VEGFR-2, PDGFRbeta, KIT or Raf kinase C, 1-methyl-5-((2-(5-(trifluoromethyl)-1H-imidazol-2-yl)pyridin-4-yl)oxy)-N-(4-(trifluoromethyl)phenyl)-1H-benzo[d]imidazol-2-amine (Compound A37) or a compound disclosed in PCT Publication No. WO 2007/030377 to treat a disorder, e.g., a disorder described herein. In one embodiment, the inhibitor of one or more of VEGFR-2, PDGFRbeta, KIT or Raf kinase C is 1-methyl-5-((2-(5-(trifluoromethyl)-1H-imidazol-2-yl)pyridin-4-yl)oxy)-N-(4-(trifluoromethyl)phenyl)-1H-benzo[d]imidazol-2-amine (Compound A37) or a compound disclosed in PCT Publication No. WO 2007/030377.

In another embodiment, the combination, e.g., a combination comprising an anti-human ENTPD2 antibody molecule as described herein, includes or is used in combination a somatostatin agonist and/or growth hormone release inhibitor, Pasireotide diaspartate (also known as SIGNIFOR; Compound A38) or a compound disclosed in PCT Publication No. WO2002/010192 or U.S. Pat. No. 7,473,761 to treat a disorder, e.g., a disorder described herein. In one embodiment, the somatostatin agonist and/or growth hormone release inhibitor is Pasireotide diaspartate (Compound A38) or a compound disclosed in PCT Publication No. WO2002/010192 or U.S. Pat. No. 7,473,761.

In another embodiment, the combination, e.g., a combination comprising an anti-human ENTPD2 antibody molecule as described herein, includes or is used in combination a signal transduction modulator and/or angiogenesis inhibitor, e.g., to treat a disorder such as a cancer as described herein.

In another embodiment, the combination, e.g., a combination comprising an anti-human ENTPD2 antibody molecule as described herein, includes or is used in combination with an EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40) or a compound disclosed in PCT Publication No. WO 2013/184757 to treat a disorder, e.g., a disorder described herein. In one embodiment, the EGFR inhibitor is (R,E)-N-(7-chloro-1-(1-

(4-(dimethylamino) but-2-enoyl)azepan-3-yl)-1H-benzo[d] imidazol-2-yl)-2-methylisonicotinamide (Compound A40) or a compound disclosed in PCT Publication No. WO 2013/184757. In one embodiment, an anti-human ENTPD2 antibody molecule is used in combination with (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757, to treat a disorder such as a cancer.

In some embodiments, the EGFR inhibitor, (R,E)-N-(7-chloro-1-(1-(4-(dimethylamino)but-2-enoyl)azepan-3-yl)-1H-benzo[d]imidazol-2-yl)-2-methylisonicotinamide (Compound A40), or a compound disclosed in PCT Publication No. WO 2013/184757, is administered in combination with an inhibitor of ENTPD2 (e.g., an anti-human ENTPD2 antibody molecule) to treat a cancer.

In another embodiment, the combination, e.g., a combination comprising an anti-human ENTPD2 antibody molecule as described herein, includes or is used in combination an ALK inhibitor, $N^6$-(2-isopropoxy-5-methyl-4-(1-methylpiperidin-4-yl)phenyl)-$N^4$-(2-(isopropylsulfonyl)phenyl)-1H-pyrazolo[3,4-d]pyrimidine-4,6-diamine (Compound A42) or a compound disclosed in PCT Publication No. WO 2008/073687 to treat a disorder, e.g., a disorder described herein. In one embodiment, the ALK inhibitor is $N^6$-(2-isopropoxy-5-methyl-4-(1-methylpiperidin-4-yl)phenyl)-$N^4$-(2-(isopropylsulfonyl)phenyl)-1H-pyrazolo[3,4-d]pyrimidine-4,6-diamine (Compound A42) or a compound disclosed in PCT Publication No. WO 2008/073687.

In another embodiment, the combination, e.g., a combination comprising an anti-human ENTPD2 antibody molecule as described herein, includes or is used in combination an IGF-1R inhibitor, 3-(4-(4-((5-chloro-4-((5-methyl-1H-pyrazol-3-yl)amino)pyrimidin-2-yl)amino)-5-fluoro-2-methylphenyl)piperidin-1-yl)thietane 1,1-dioxide (Compound A43), 5-chloro-$N^2$-(2-fluoro-5-methyl-4-(1-(tetrahydro-2H-pyran-4-yl)piperidin-4-yl)phenyl)-$N^4$-(5-methyl-1H-pyrazol-3-yl)pyrimidine-2,4-diamine (Compound A44), or 5-chloro-N2-(4-(1-ethylpiperidin-4-yl)-2-fluoro-5-methylphenyl)-$N^4$-(5-methyl-1H-pyrazol-3-yl)pyrimidine-2,4-diamine (Compound A45) or a compound disclosed in PCT Publication No. WO 2010/002655 to treat a disorder, e.g., a disorder described. In one embodiment, the IGF-1R inhibitor is 3-(4-(4-((5-chloro-4-((5-methyl-1H-pyrazol-3-yl)amino)pyrimidin-2-yl)amino)-5-fluoro-2-methylphenyl)piperidin-1-yl)thietane 1,1-dioxide (Compound A43), 5-chloro-$N^2$-(2-fluoro-5-methyl-4-(1-(tetrahydro-2H-pyran-4-yl)piperidin-4-yl)phenyl)-$N^4$-(5-methyl-1H-pyrazol-3-yl)pyrimidine-2,4-diamine (Compound A44), 5-chloro-N2-(4-(1-ethylpiperidin-4-yl)-2-fluoro-5-methylphenyl)-$N^4$-(5-methyl-1H-pyrazol-3-yl)pyrimidine-2,4-diamine (Compound A45), or a compound disclosed in PCT Publication No. WO 2010/002655.

In another embodiment, the combination, e.g., a combination comprising an anti-human ENTPD2 antibody molecule as described herein, includes or is used in combination a P-Glycoprotein 1 inhibitor, Valspodar (also known as AMDRAY; Compound A46) or a compound disclosed in EP 296122 to treat a disorder, e.g., a disorder described herein. In one embodiment, the P-Glycoprotein 1 inhibitor is Valspodar (Compound A46) or a compound disclosed in EP 296122.

In another embodiment, the combination, e.g., a combination comprising an anti-human ENTPD2 antibody molecule as described herein, includes or is used in combination one or more of a VEGFR inhibitor, Vatalanib succinate (Compound A47) or a compound disclosed in EP 296122 to treat a disorder, e.g., a disorder described herein. In one embodiment, the VEGFR inhibitor is Vatalanib succinate (Compound A47) or a compound disclosed in EP 296122.

In another embodiment, the combination, e.g., a combination comprising an anti-human ENTPD2 antibody molecule as described herein, includes or is used in combination with an IDH inhibitor or a compound disclosed in WO2014/141104 to treat a disorder, e.g., a disorder described herein. In one embodiment, the IDH inhibitor is a compound disclosed in PCT Publication No. WO2014/141104.

In another embodiment, the combination, e.g., a combination comprising an anti-human ENTPD2 antibody molecule as described herein, includes or is used in combination with a BCL-ABL inhibitor or a compound disclosed in PCT Publication No. WO2013/171639, WO2013/171640, WO2013/171641, or WO2013/171642 to treat a disorder, e.g., a disorder described herein. In one embodiment, the BCL-ABL inhibitor is a compound disclosed in PCT Publication No. WO2013/171639, WO2013/171640, WO2013/171641, or WO2013/171642.

In another embodiment, the combination, e.g., a combination comprising an anti-human ENTPD2 antibody molecule as described herein, includes or is used in combination with a c-RAF inhibitor or a compound disclosed in PCT Publication No. WO2014/151616 to treat a disorder, e.g., a disorder described herein. In one embodiment, the c-RAF inhibitor is Compound A50 or a compound disclosed in PCT Publication No. WO2014/151616. In some embodiments, the c-RAF inhibitor or Compound A50 is a compound of formula (I):

b.

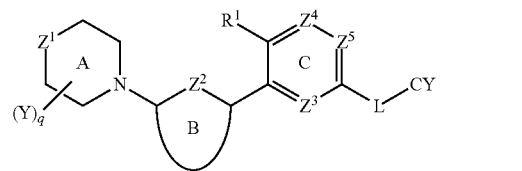

(I)

c. or a pharmaceutically acceptable salt thereof, wherein:
d. $Z^1$ is O, S, S(=O) or $SO_2$;
e. $Z^2$ is N, S or $CR^a$, where $R^a$ is H, halo, $C_{1-4}$ alkyl or $C_{1-4}$ haloalkyl;
f. $R^1$ is CN, halo, OH, $C_{1-4}$ alkoxy, or $C_{1-4}$ alkyl that is optionally substituted with one to three groups selected from halo, $C_{1-4}$ alkoxy, CN, and hydroxyl;
g. Ring B is selected from phenyl, pyridine, pyrimidine, pyrazine, pyridazine, pyridone, pyrimidone, pyrazinone, pyridazinone, and thiazole, each of which is optionally substituted with up to two groups selected from halo, OH, CN, $C_{1-4}$ alkyl, $C_{2-4}$ alkenyl, —O—($C_{1-4}$ alkyl), $NH_2$, NH—($C_{1-4}$ alkyl), —N($C_{1-4}$ alkyl)$_2$, —$SO_2R^2$, $NHSO_2R^2$, $NHC(O)R^2$, $NHCO_2R^2$, $C_{3-6}$ cycloalkyl, 5-6 membered heteroaryl, —O—$C_{3-6}$ cycloalkyl, —O-(5-6-membered heteroaryl), $C_{4-8}$ heterocycloalkyl, and —O-(4-8 membered heterocycloalkyl), where each heterocycloalkyl and heteroaryl contains up to three heteroatoms selected from N, O and S as ring members,
i. where each $C_{1-4}$ alkyl, $C_{2-4}$ alkenyl, $C_{3-6}$ cycloalkyl, 5-6 membered heteroaryl, and 4-8 membered heterocycloalkyl is each optionally substituted with up to three groups selected from oxo, hydroxyl, halo, $C_{1-4}$ alkyl, $C_{1-4}$ haloalkyl, $C_{1-4}$ alkoxy, and —$(CH_2)_{1-2}Q$ where Q is OH, $C_{1-4}$ alkoxy, —CN, $NH_2$, —$NHR^3$, —$N(R^3)_2$, —$SO_2R^3$, $NHSO_2R^3$, $NHC(O)OR^3$, or $NHC(O)R^3$; each $R^2$ and $R^3$ is independently $C_{1-4}$ alkyl; and ii. Ring B is optionally fused to a 5-6 membered aromatic or nonaromatic ring containing up to two heteroatoms selected from N, O and S, where the 5-6 membered ring can be substituted with halo, $C_{1-4}$ alkyl, $C_{1-4}$ haloalkyl, or $C_{1-4}$ alkoxy, and if the fused ring is non-aromatic the substituent options can further include oxo;

h. each Y is independently selected from $C_{1-4}$ alkyl, $C_{1-4}$ alkoxy, CN, halo, oxo, —$(CH_2)_pOR^4$, —$(CH_2)p$ $N(R^4)_2$, —$(CH_2)pNHC(O)R^4$, —$(CH_2)_pNHCOO(C_{1-4}$ alkyl), and imidazole, i. or two Y groups on Ring A are optionally taken together to form a ring fused to or bridging Ring A, where said fused or bridging ring optionally contains a heteroatom selected from N, O and S as a ring member, and is optionally substituted with up to two groups selected from $C_{1-4}$ alkyl, $C_{1-4}$ alkoxy, CN, halo, oxo, —$(CH_2)_p$ $OR^4$, —$(CH_2)_P$ $N(R^4)_2$, —$(CH_2)_pNHC(O)R^4$, and —$(CH_2)_pNHCOO(C_{1-4}$ alkyl);

j. each $R^4$ is independently H or $C_{1-4}$ alkyl;

k. each p is independently 0, 1, or 2;

l. q is 0, 1 or 2;

m. $Z^3$, $Z^4$, and $Z^5$ are independently selected from CH and N and optionally NO;

n. L is —C(=O)—$NR^4$—[CY] or —$NR^4$—C(=O)—[CY], where [CY] indicates which atom of L is attached to CY; and o. CY is an aromatic ring selected from phenyl, pyridine, pyrimidine, pyrazine, pyridazine, pyridone, thiazole, isothiazole, oxazole, pyrazole, and isoxazole, wherein the ring is optionally fused to a thiophene, imidazole, oxazolone, or pyrrole ring;

p. and CY is substituted with up to two groups selected from halo, CN, $R^5$, $OR^5$, $SO_2R^5$, —S(=NH)(=O)$R^5$, OH, $NH_2$, $NHR^5$, and —$N(R^5)_2$, i. wherein each $R^5$ is independently $C_{1-4}$ alkyl, $C_{2-4}$ alkenyl, $C_{2-6}$ heterocyclyl, 5-membered heteroaryl containing up to three heteroatoms selected from N, O and S as ring members, or $C_{3-8}$ cycloalkyl, and $R^5$ is optionally substituted with up to four groups selected from oxo, halo, CN, $R^6$, OH, $OR^6$, $SO_2R^6$, $NH_2$, $NHR^6$, $N(R^6)_2$, $NHSO_2R^6$, $NHCOOR^6$, $NHC(=O)R^6$, —$CH_2OR^7$, —$CH_2N(R^7)_2$, wherein each q. $R^6$ is independently $C_{1-4}$ alkyl, and each $R^7$ is independently H or $C_{1-4}$ alkyl;

r. and two $R^4$, $R^5$, $R^6$, or $R^7$ on the same nitrogen atom can be taken together to form a 5-6 membered heterocyclic ring optionally containing an additional N, O or S as a ring member and optionally substituted with up to two groups selected from $C_{1-4}$ alkyl, oxo, halo, OH, and $C_{1-4}$ alkoxy.

Exemplary Cell Therapies

Anti-human ENTPD2 antibody molecules can also be combined with a cell therapy, e.g., a chimeric antigen receptor (CAR) therapy, a T cell therapy, a natural killer (NK) cell therapy, or a dendritic cell therapy.

Combinations with CAR Therapies

The anti-human ENTPD2 antibody molecules described herein can be administered in combination with a second therapeutic, e.g., a cell comprising a chimeric antigen receptor (CAR). The CAR may comprise i) an extracellular antigen binding domain, ii) a transmembrane domain, and iii) an intracellular signaling domain (which may comprise one or both of a primary signaling domain and a costimulatory domain). The CAR may further comprise a leader sequence and/or a hinge sequence. In specific embodiments, the CAR construct comprises a scFv domain, wherein the scFv may be preceded by an optional leader sequence, and followed by an optional hinge sequence, a transmembrane region, and an intracellular signaling domain, e.g., wherein the domains are contiguous with and in the same reading frame to form a single fusion protein.

In some embodiments, the CAR molecule comprises a CD19 CAR molecule described herein, e.g., a CD19 CAR molecule described in US 2015/0283178, e.g., CTL019. In embodiments, the CD19 CAR comprises an amino acid, or has a nucleotide sequence shown in US 2015/0283178, incorporated herein by reference in its entirety, or a sequence substantially identical thereto (e.g., a sequence having at least about 85%, 90%, or 95% sequence identity thereto).

In one embodiment, the CART cell that binds to CD19 has the USAN designation TISAGENLECLEUCEL-T. CTL019 is made by a gene modification of T cells mediated by stable insertion via transduction with a self-inactivating, replication deficient lentiviral (LV) vector containing the CTL019 transgene under the control of the EF-1 alpha promoter. CTL019 can be a mixture of transgene positive and negative T cells that are delivered to the subject on the basis of percent transgene positive T cells.

In one embodiment, the CD19 CAR comprises an amino acid sequence provided as SEQ ID NO: 12 in PCT publication WO2012/079000. In embodiment, the amino acid sequence is:

MALPVTALLLPLALLLHAARPdiqmtqttssl-saslgdrvtiscrasqdiskylnwyqqkpdgtvklliy htsrlhsgvpsrfsgsgsgtdysltisnleqediatyfcqqgntlpy-tfgggtkleitggggsggggsggggsevklqesg pglvapsqsl-sytctvsgyslpdygyswirqpprkglewlgviwgsettyyn-salksrltiikdnsksqvflkmnslqtd dtaiyycakhyyyggsyamdywgqgtsytyssittpaprpptpaptia-sqplslrpeacrpaaggavhtrgldfacdiyi waplagtcgvlllslvit-lyckrgrkklly-ifkqpfmrpvqttqeedgcscrfpeeeeggcelrvkfsrsadapaykqgqn qlynelnlgrreeydvldkrrgrdpemggkprrknpqeglynelqkdk-maeayseigmkgerrrgkghdglyqglst atkdtydalhmqalppr (SEQ ID NO: 312), or a sequence substantially identical thereto (e.g., a sequence having at least about 85%, 90%, or 95% sequence identity thereto), with or without the signal peptide sequence indicated in capital letters.

In one embodiment, the amino acid sequence is:
diqmtqttsslsaslgdrvtiscrasqdisky-lnwyqqkpdgtvklliyhtsrlhsgvpsrfsgsgsgtdysltisnleqedi atyfcqqgntlpytfgggtkleitggggsggggsgggg-sevklqesgpglvapsqslsvtctvsgvslpdygvswirqp prkglew-lgviwgsettyynsalksrltiikdnsksqvflkmnslqtddtaiyy-cakhyyyggsyamdywgqgtsvt vsstttpaprpptpaptiasqplslrpeacrpaaggavhtrgldfacdiyi-waplagtcgvlllslvitlyckrgrkkllyifkq pfmrpvqttqeedgcscrfpeeeeggcelrvkfsrsadapa-ykqgqnqlynelnlgrreeydvldkagrdpemggk prrknpqegly-nelqkdkmaeayseigmkgeragkghdglyqglstatkdty-dalhmqalppr (SEQ ID NO: 313), or a sequence substantially homologous thereto (e.g., a sequence having at least about 85%, 90%, or 95% sequence identity thereto).

Antigen Binding Domain of a Chimeric Antigen Receptor (CAR)

The antigen binding domain can be any domain that binds to the antigen including but not limited to a monoclonal antibody, a polyclonal antibody, a recombinant antibody, a human antibody, a humanized antibody, and a functional fragment thereof, including but not limited to a single-domain antibody such as a heavy chain variable domain (VH), a light chain variable domain (VL) and a variable domain (VHH) of camelid derived nanobody, and to an alternative scaffold known in the art to function as antigen binding domain, such as a recombinant fibronectin domain, a T cell receptor (TCR), or a fragment there of, e.g., single chain TCR, and the like. In some instances, it is beneficial for the antigen binding domain to be derived from the same species in which the CAR will ultimately be used in. For example, for use in humans, it may be beneficial for the antigen binding domain of the CAR to comprise human or humanized residues for the antigen binding domain of an antibody or antibody fragment.

In some embodiments, the antigen binding domain of the CAR is a scFv antibody fragment that is humanized compared to the murine sequence of the scFv from which it is derived.

In some embodiments, the antigen binding domain binds a tumor antigen described herein. In embodiments, the tumor antigen is chosen from: CD19; CD123; CD22; CD30; CD171; CS-1 (also referred to as CD2 subset 1, CRACC, SLAMF7, CD319, and 19A24); C-type lectin-like molecule-1 (CLL-1 or CLECL1); CD33; epidermal growth factor receptor variant III (EGFRvIII); ganglioside G2 (GD2); ganglioside GD3 (aNeu5Ac(2-8)aNeu5Ac(2-3)bD-Galp(1-4)bDGlcp(1-1)Cer); TNF receptor family member B cell maturation (BCMA); Tn antigen ((Tn Ag) or (GalNAca-Ser/Thr)); prostate-specific membrane antigen (PSMA); Receptor tyrosine kinase-like orphan receptor 1 (ROR1); Fms-Like Tyrosine Kinase 3 (FLT3); Tumor-associated glycoprotein 72 (TAG72); CD38; CD44v6; Carcinoembryonic antigen (CEA); Epithelial cell adhesion molecule (EP-CAM); B7H3 (CD276); KIT (CD117); Interleukin-13 receptor subunit alpha-2 (IL-13Ra2 or CD213A2); Mesothelin; Interleukin 11 receptor alpha (IL-11Ra); prostate stem cell antigen (PSCA); Protease Serine 21 (Testisin or PRSS21); vascular endothelial growth factor receptor 2 (VEGFR2); Lewis(Y) antigen; CD24; Platelet-derived growth factor receptor beta (PDGFR-beta); Stage-specific embryonic antigen-4 (SSEA-4); CD20; Folate receptor alpha; Receptor tyrosine-protein kinase ERBB2 (Her2/neu); Mucin 1, cell surface associated (MUC1); epidermal growth factor receptor (EGFR); neural cell adhesion molecule (NCAM); Prostase; prostatic acid phosphatase (PAP); elongation factor 2 mutated (ELF2M); Ephrin B2; fibroblast activation protein alpha (FAP); insulin-like growth factor 1 receptor (IGF-I receptor), carbonic anhydrase IX (CAIX); Proteasome (Prosome, Macropain) Subunit, Beta Type, 9 (LMP2); glycoprotein 100 (gp100); oncogene fusion protein consisting of breakpoint cluster region (BCR) and Abelson murine leukemia viral oncogene homolog 1 (Abl) (bcr-abl); tyrosinase; ephrin type-A receptor 2 (EphA2); Fucosyl GM1; sialyl Lewis adhesion molecule (sLe); ganglioside GM3 (aNeu5Ac(2-3)bDGalp(1-4)bDGlcp(1-1)Cer); transglutaminase 5 (TGSS); high molecular weight-melanoma-associated antigen (HMWMAA); o-acetyl-GD2 ganglioside (OAcGD2); Folate receptor beta; tumor endothelial marker 1 (TEM1/CD248); tumor endothelial marker 7-related (TEM7R); claudin 6 (CLDN6); thyroid stimulating hormone receptor (TSHR); G protein-coupled receptor class C group 5, member D (GPRC5D); chromosome X open reading frame 61 (CXORF61); CD97; CD179a; anaplastic lymphoma kinase (ALK); Polysialic acid; placenta-specific 1 (PLAC1); hexasaccharide portion of globoH glycoceramide (GloboH); mammary gland differentiation antigen (NY-BR-1); uroplakin 2 (UPK2); Hepatitis A virus cellular receptor 1 (HAVCR1); adrenoceptor beta 3 (ADRB3); pannexin 3 (PANX3); G protein-coupled receptor 20 (GPR20); lymphocyte antigen 6 complex, locus K 9 (LY6K); Olfactory receptor 51E2 (OR51E2); TCR Gamma Alternate Reading Frame Protein (TARP); Wilms tumor protein (WT1); Cancer/testis antigen 1 (NY-ESO-1); Cancer/testis antigen 2 (LAGE-1a); Melanoma-associated antigen 1 (MAGE-A1); ETS translocation-variant gene 6, located on chromosome 12p (ETV6-AML); sperm protein 17 (SPA17); X Antigen Family, Member 1A (XAGE1); angiopoietin-binding cell surface receptor 2 (Tie 2); melanoma cancer testis antigen-1 (MAD-CT-1); melanoma cancer testis antigen-2 (MAD-CT-2); Fos-related antigen 1; tumor protein p53 (p53); p53 mutant; prostein; surviving; telomerase; prostate carcinoma tumor antigen-1 (PCTA-1 or Galectin 8), melanoma antigen recognized by T cells 1 (MelanA or MART1); Rat sarcoma (Ras) mutant; human Telomerase reverse transcriptase (hTERT); sarcoma translocation breakpoints; melanoma inhibitor of apoptosis (ML-IAP); ERG (transmembrane protease, serine 2 (TMPRSS2) ETS fusion gene); N-Acetyl glucosaminyl-transferase V (NA17); paired box protein Pax-3 (PAX3); Androgen receptor; Cyclin B1; v-myc avian myelocytomatosis viral oncogene neuroblastoma derived homolog (MYCN); Ras Homolog Family Member C (RhoC); Tyrosinase-related protein 2 (TRP-2); Cytochrome P450 1B1 (CYP1B1); CCCTC-Binding Factor (Zinc Finger Protein)-Like (BORIS or Brother of the Regulator of Imprinted Sites), Squamous Cell Carcinoma Antigen Recognized By T Cells 3 (SART3); Paired box protein Pax-5 (PAX5); proacrosin binding protein sp32 (OY-TES1); lymphocyte-specific protein tyrosine kinase (LCK); A kinase anchor protein 4 (AKAP-4); synovial sarcoma, X breakpoint 2 (SSX2); Receptor for Advanced Glycation Endproducts (RAGE-1); renal ubiquitous 1 (RU1); renal ubiquitous 2 (RU2); legumain; human papilloma virus E6 (HPV E6); human papilloma virus E7 (HPV E7); intestinal carboxyl esterase; heat shock protein 70-2 mutated (mut hsp70-2); CD79a; CD79b; CD72; Leukocyte-associated immunoglobulin-like receptor 1 (LAIR1); Fc fragment of IgA receptor (FCAR or CD89); Leukocyte immunoglobulin-like receptor subfamily A member 2 (LILRA2); CD300 molecule-like family member f (CD300LF); C-type lectin domain family 12 member A (CLEC12A); bone marrow stromal cell antigen 2 (BST2); EGF-like module-containing mucin-like hormone receptor-like 2 (EMR2); lymphocyte antigen 75 (LY75); Glypican-3 (GPC3); Fc receptor-like 5 (FCRL5); and immunoglobulin lambda-like polypeptide 1 (IGLL1).

In one embodiment, the CAR molecule comprises a BCMA CAR molecule, e.g., a BCMA CAR described in US 2016/0046724 or WO 2016/014565, incorporated herein by reference. In embodiments, the BCMA CAR comprises an amino acid, or has a nucleotide sequence of a CAR molecule, or an antigen binding domain according to US 2016/0046724, or Table 1 or 16, SEQ ID NO: 271 or SEQ ID NO: 273 of WO 2016/014565, incorporated herein by reference, or a sequence substantially identical to any of the aforesaid sequences (e.g., having at least about 85%, 90%, or 95% sequence identity to any of the aforesaid BCMA CAR sequences). The amino acid and nucleotide sequences encoding the BCMA CAR molecules and antigen binding domains (e.g., including one, two, three VH CDRs; and one, two, three VL CDRs according to Kabat or Chothia), are specified in WO 2016/014565.

Transmembrane Domain of a Chimeric Antigen Receptor (CAR)

With respect to the transmembrane domain, in various embodiments, a CAR can be designed to comprise a transmembrane domain that is attached to the extracellular domain of the CAR.

The transmembrane domain may be derived either from a natural or from a recombinant source. Where the source is natural, the domain may be derived from any membrane-bound or transmembrane protein. In one aspect the transmembrane domain is capable of signaling to the intracellular domain(s) whenever the CAR has bound to a target. A transmembrane domain may include at least the transmembrane region(s) of e.g., the alpha, beta or zeta chain of the T-cell receptor, CD28, CD27, CD3 epsilon, CD45, CD4, CD5, CD8, CD9, CD16, CD22, CD33, CD37, CD64, CD80, CD86, CD134, CD137, CD154. In some embodiments, a transmembrane domain may include at least the transmembrane region(s) of, e.g., KIRDS2, OX40, CD2, CD27, LFA-1 (CD11a, CD18), ICOS (CD278), 4-1BB (CD137), GITR, CD40, BAFFR, HVEM (LIGHTR), SLAMF7, NKp80 (KLRF1), NKp44, NKp30, NKp46, CD160, CD19, IL2R beta, IL2R gamma, IL7R-α, ITGA1, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, DNAM1 (CD226), SLAMF4 (CD244, 2B4), CD84, CD96 (Tactile), CEACAM1, CRTAM, Ly9 (CD229), CD160 (BY55), PSGL1, CD100 (SEMA4D), SLAMF6 (NTB-A, Ly108), SLAM (SLAMF1, CD150, IPO-3), BLAME (SLAMF8), SELPLG (CD162), LTBR, PAG/Cbp, NKG2D, or NKG2C.

In some instances, the transmembrane domain can be attached to the extracellular region of the CAR, e.g., the antigen binding domain of the CAR, via a hinge, e.g., a hinge from a human protein. For example, in one embodiment, the hinge can be a human Ig (immunoglobulin) hinge (e.g., an IgG4 hinge, an IgD hinge), a GS linker (e.g., a GS linker described herein), a KIR2DS2 hinge or a CD8a hinge.

Intracellular Signaling Domain of a Chimeric Antigen Receptor (CAR)

The cytoplasmic domain or region of the CAR includes an intracellular signaling domain. An intracellular signaling domain is generally responsible for activation of at least one of the normal effector functions of the immune cell in which the CAR has been introduced.

Examples of intracellular signaling domains for use in the CAR include the cytoplasmic sequences of the T cell receptor (TCR) and co-receptors that act in concert to initiate signal transduction following antigen receptor engagement, as well as any derivative or variant of these sequences and any recombinant sequence that has the same functional capability.

A primary signaling domain regulates primary activation of the TCR complex either in a stimulatory way, or in an inhibitory way. Primary intracellular signaling domains that act in a stimulatory manner may contain signaling motifs which are known as immunoreceptor tyrosine-based activation motifs or ITAMs.

Examples of ITAM containing primary intracellular signaling domains include those of CD3 zeta, common FcR gamma (FCER1G), Fc gamma RIIa, FcR beta (Fc Epsilon R1b), CD3 gamma, CD3 delta, CD3 epsilon, CD79a, CD79b, DAP10, and DAP12. In one embodiment, a CAR comprises an intracellular signaling domain, e.g., a primary signaling domain of CD3-zeta.

The intracellular signaling domain of the CAR can comprise the CD3-zeta signaling domain by itself or it can be combined with any other desired intracellular signaling domain(s) useful in the context of a CAR of the invention. For example, the intracellular signaling domain of the CAR can comprise a CD3 zeta chain portion and a costimulatory signaling domain. The costimulatory signaling domain refers to a portion of the CAR comprising the intracellular domain of a costimulatory molecule. A costimulatory molecule is a cell surface molecule other than an antigen receptor or its ligands that is required for an efficient response of lymphocytes to an antigen. Examples of such molecules include CD27, CD28, 4-1BB (CD137), OX40, CD30, CD40, PD-1, ICOS, lymphocyte function-associated antigen-1 (LFA-1), CD2, CD7, LIGHT, NKG2C, B7-H3, and a ligand that binds to CD83, and the like. For example, CD27 costimulation has been demonstrated to enhance expansion, effector function, and survival of human CART cells in vitro and augments human T cell persistence and antitumor activity in vivo (Song et al. Blood. 2012; 119(3): 696-706). Further examples of such costimulatory molecules include CDS, ICAM-1, GITR, BAFFR, HVEM (LIGHTR), SLAMF7, NKp80 (KLRF1), NKp44, NKp30, NKp46, CD160, CD19, CD4, CD8alpha, CD8beta, IL2R beta, IL2R gamma, IL7R alpha, ITGA4, VLA1, CD49a, ITGA4, IA4, CD49D, ITGA6, VLA-6, CD49f, ITGAD, CD11d, ITGAE, CD103, ITGAL, CD11a, LFA-1, ITGAM, CD11b, ITGAX, CD11c, ITGB1, CD29, ITGB2, CD18, LFA-1, ITGB7, TNFR2, TRANCE/RANKL, DNAM1 (CD226), SLAMF4 (CD244, 2B4), CD84, CD96 (Tactile), NKG2D, CEACAM1, CRTAM, Ly9 (CD229), CD160 (BY55), PSGL1, CD100 (SEMA4D), CD69, SLAMF6 (NTB-A, Ly108), SLAM (SLAMF1, CD150, IPO-3), BLAME (SLAMF8), SELPLG (CD162), LTBR, LAT, GADS, SLP-76, PAG/Cbp, and CD19a.

Activation and Expansion of Immune Effector Cells (e.g., T Cells)

Immune effector cells such as T cells may be activated and expanded generally using methods as described, for example, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 2006/0121005, incorporated herein by reference.

Examples of immune effector cells include T cells, e.g., alpha/beta T cells and gamma/delta T cells, B cells, natural killer (NK) cells, natural killer T (NKT) cells, mast cells, and myeloid-derived phagocytes.

Methods of making CAR-expressing cells are described, e.g., in US 2016/0185861, incorporated herein by reference.

Exemplary Cancer Vaccines

Anti-human ENTPD2 antibody molecules can be combined with an immunogenic agent, such as cancerous cells, purified tumor antigens (including recombinant proteins, peptides, and carbohydrate molecules), cells, and cells transfected with genes encoding immune stimulating cytokines (He et al. (2004) J. Immunol. 173:4919-28). Non-limiting examples of tumor vaccines that can be used include peptides of melanoma antigens, such as peptides of gp100, MAGE antigens, Trp-2, MART1 and/or tyrosinase, tumor cells transfected to express the cytokine GM-CSF, DNA-based vaccines, RNA-based vaccines, and viral transduction-based vaccines. The cancer vaccine may be prophylactic or therapeutic.

ENTPD2 blockade can be used in conjunction with a collection of recombinant proteins and/or peptides expressed in a tumor in order to generate an immune response to these proteins.

Other tumor vaccines may include the proteins from viruses implicated in human cancers such a Human Papilloma Viruses (HPV), Hepatitis Viruses (HBV and HCV), Kaposi's Herpes Sarcoma Virus (KHSV), and Epstein-Barr virus (EBV). Another form of tumor specific antigen which may be used in conjunction with ENTPD2 blockade is purified heat shock proteins (HSP) isolated from the tumor tissue itself. These heat shock proteins contain fragments of proteins from the tumor cells and these HSPs are highly efficient at delivery to antigen presenting cells for eliciting tumor immunity (Suot, R & Srivastava, P (1995) *Science* 269:1585-1588; Tamura, Y. et al. (1997) *Science* 278:117-120).

Dendritic cells (DC) are potent antigen presenting cells that can be used to prime antigen-specific responses. DC's can be produced ex vivo and loaded with various protein and peptide antigens as well as tumor cell extracts (Nestle, F. et al. (1998) *Nature Medicine* 4: 328-332). DCs may also be transduced by genetic means to express these tumor antigens as well. DCs have also been fused directly to tumor cells for the purposes of immunization (Kugler, A. et al. (2000) *Nature Medicine* 6:332-336). As a method of vaccination, DC immunization may be effectively combined with CD73 blockade to activate more potent anti-tumor responses.

Exemplary Oncolytic Viruses

Anti-human ENTPD2 antibody molecules can be administered in combination with oncolytic viruses. In embodiments, oncolytic viruses are capable of selectively replicating in and triggering the death of or slowing the growth of a cancer cell. In some cases, oncolytic viruses have no effect or a minimal effect on non-cancer cells. In some embodiments, the combination is used to treat a cancer, e.g., a cancer described herein. An oncolytic virus includes, but is not limited to, an oncolytic adenovirus, oncolytic Herpes Simplex Viruses, oncolytic retrovirus, oncolytic parvovirus, oncolytic vaccinia virus, oncolytic Sindbis virus, oncolytic influenza virus, or oncolytic RNA virus (e.g., oncolytic reovirus, oncolytic Newcastle Disease Virus (NDV), oncolytic measles virus, or oncolytic vesicular stomatitis virus (VSV)).

Exemplary oncolytic viruses include but are not limited to the following:
- Group B Oncolytic Adenovirus (ColoAd1) (PsiOxus Therapeutics Ltd.) (see, e.g., Clinical Trial Identifier: NCT02053220);
- ONCOS-102 (previously called CGTG-102), which is an adenovirus comprising granulocyte-macrophage colony stimulating factor (GM-CSF) (Oncos Therapeutics) (see, e.g., Clinical Trial Identifier: NCT01598129);
- VCN-01, which is a genetically modified oncolytic human adenovirus encoding human PH20 hyaluronidase (VCN Biosciences, S.L.) (see, e.g., Clinical Trial Identifiers: NCT02045602 and NCT02045589);
- Conditionally Replicative Adenovirus ICOVIR-5, which is a virus derived from wild-type human adenovirus serotype 5 (Had5) that has been modified to selectively replicate in cancer cells with a deregulated retinoblastoma/E2F pathway (Institut Català d'Oncologia) (see, e.g., Clinical Trial Identifier: NCT01864759);
- Celyvir, which comprises bone marrow-derived autologous mesenchymal stem cells (MSCs) infected with ICOVIR5, an oncolytic adenovirus (Hospital Infantil Universitario Niño Jesús, Madrid, Spain/Ramon Alemany) (see, e.g., Clinical Trial Identifier: NCT01844661);
- CG0070, which is a conditionally replicating oncolytic serotype 5 adenovirus (Ad5) in which human E2F-1 promoter drives expression of the essential Ela viral genes, thereby restricting viral replication and cytotoxicity to Rb pathway-defective tumor cells (Cold Genesys, Inc.) (see, e.g., Clinical Trial Identifier: NCT02143804); or
- DNX-2401 (formerly named Delta-24-RGD), which is an adenovirus that has been engineered to replicate selectively in retinoblastoma (Rb)-pathway deficient cells and to infect cells that express certain RGD-binding integrins more efficiently (Clinica Universidad de Navarra, Universidad de Navarra/DNAtrix, Inc.) (see, e.g., Clinical Trial Identifier: NCT01956734).

In some embodiments, an oncolytic virus described herein is administering by injection, e.g., subcutaneous, intraarterial, intravenous, intramuscular, intrathecal, or intraperitoneal injection. In embodiments, an oncolytic virus described herein is administered intratumorally, transdermally, transmucosally, orally, intranasally, or via pulmonary administration.

Additional Exemplary Cancer Therapies

Exemplary combinations of anti-human ENTPD2 antibody molecules (alone or in combination with other stimulatory agents) and standard of care for cancer, include at least the following. In certain embodiments, the anti-human ENTPD2 antibody molecule, e.g., the anti-human ENTPD2 antibody molecule described herein, is used in combination with a standard of cancer care chemotherapeutic agent including, but not limited to, anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®) dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), vinorelbine (Navelbine®), Ibrutinib, idelalisib, and brentuximab vedotin.

In certain embodiments, the anti-human ENTPD2 antibody molecule, e.g., the anti-human ENTPD2 antibody molecule described herein, is used in combination with an alkylating agent including, but not limited to, nitrogen mustards, ethylenimine derivatives, alkyl sulfonates, nitrosoureas and triazenes): uracil mustard (Aminouracil Mustard®, Chlorethaminacil®, Demethyldopan®, Desmethyldopan®, Haemanthamine®, Nordopan®, Uracil nitrogen Mustard®, Uracillost®, Uracilmostaza®, Uramustin®, Uramustine®), chlormethine (Mustargen®), cyclophosphamide (Cytoxan®, Neosar®, Clafen®, Endoxan®, Procytox®, Revimmune™), ifosfamide (Mitoxana®), melphalan (Alkeran®), Chlorambucil (Leukeran®), pipobroman (Amedel®, Vercyte®), triethylenemelamine (Hemel®, Hexalen®, Hexastat®), triethylenethiophosphoramine, Temozolomide (Temodar®), thiotepa (Thioplex®), busulfan (Busilvex®, Myleran®), carmustine (BiCNU®), lomustine (CeeNU®), streptozocin (Zanosar®), and Dacarbazine (DTIC-Dome®). Additional exemplary alkylating agents include, without limitation, Oxaliplatin (Eloxatin®); Temozolomide (Temodar® and Temodal®); Dactinomycin (also known as actinomycin-D, Cosmegen®); Melphalan (also known as L-PAM, L-sarcolysin, and phenylalanine mustard, Alkeran®); Altretamine (also known as hexamethylmelamine (HMM), Hexalen®); Carmustine (BiCNU®); Bendamustine (Treanda®); Busulfan (Busulfex® and Myleran®); Carboplatin (Paraplatin®); Lomustine (also known as CCNU, CeeNU®); Cisplatin (also known as CDDP, Platinol® and Platinol®-AQ); Chlorambucil (Leukeran®); Cyclophosphamide (Cytoxan® and Neosar®); Dacarbazine (also known as DTIC, DIC and imidazole carboxamide, DTIC-Dome®); Altretamine (also known as hexamethylmelamine (HMM), Hexalen®); Ifosfamide (Ifex®); Prednumustine; Procarbazine (Matulane®); Mechlorethamine (also known as nitrogen mustard, mustine and mechloroethamine hydrochloride, Mustargen®); Streptozocin (Zanosar®); Thiotepa (also known as thiophosphoamide, TESPA and TSPA, Thioplex®); Cyclophosphamide (Endoxan®, Cytoxan®, Neosar®, Procytox®, Revimmune®); and Bendamustine HCl (Treanda®).

In certain embodiments, the anti-human ENTPD2 antibody molecule, e.g., the anti-human ENTPD2 antibody molecule described herein, is used in combination with anthracyclines including, but not limited to, e.g., doxorubicin (Adriamycin® and Rubex®); bleomycin (Lenoxane®); daunorubicin (dauorubicin hydrochloride, daunomycin, and rubidomycin hydrochloride, Cerubidine®); daunorubicin liposomal (daunorubicin citrate liposome, DaunoXome®); mitoxantrone (DHAD, Novantrone®); epirubicin (Ellence™); idarubicin (Idamycin®, Idamycin PFS®); mitomycin C (Mutamycin®); geldanamycin; herbimycin; ravidomycin; and desacetylravidomycin. Exemplary vinca alkaloids that can be used in combination with the anti-human ENTPD2 antibody molecules, include, but are not limited to, vinorelbine tartrate (Navelbine®), Vincristine (Oncovin®), and Vindesine (Eldisine®)); vinblastine (also known as vinblastine sulfate, vincaleukoblastine and VLB, Alkaban-AQ® and Velban®); and vinorelbine (Navelbine®).

Exemplary proteosome inhibitors that can be used in combination with the anti-human ENTPD2 antibody as described herein include, but are not limited to, bortezomib (Velcade®); carfilzomib (PX-171-007, (S)-4-Methyl-N—((S)-1-(((S)-4-methyl-1-((R)-2-methyloxiran-2-yl)-1-oxopentan-2-yl)amino)-1-oxo-3-phenylpropan-2-yl)-2-((S)-2-(2-morpholinoacetamido)-4-phenylbutanamido)-pentanamide); marizomib (NPI-0052); ixazomib citrate (MLN-9708); delanzomib (CEP-18770); and O-Methyl-N-[(2-methyl-5-thiazolyl)carbonyl]-L-seryl-O-methyl-N-[(1S)-2-[(2R)-2-methyl-2-oxiranyl]-2-oxo-1-(phenylmethyl)ethyl]-L-serinamide (ONX-0912).

In certain embodiments, the anti-human ENTPD2 antibody molecule, is administered in combination with radiation therapy. Radiation therapy can be administered through one of several methods, or a combination of methods, including without limitation external-beam therapy, internal radiation therapy, implant radiation, stereotactic radiosurgery, systemic radiation therapy, radiotherapy and permanent or temporary interstitial brachytherapy. The term "brachytherapy," refers to radiation therapy delivered by a spatially confined radioactive material inserted into the body at or near a tumor or other proliferative tissue disease site. The term is intended without limitation to include exposure to radioactive isotopes (e.g., At-211, I-131, I-125, Y-90, Re-186, Re-188, Sm-153, Bi-212, P-32, and radioactive isotopes of Lu). Suitable radiation sources for use as a cell conditioner of the present invention include both solids and liquids. By way of non-limiting example, the radiation source can be a radionuclide, such as I-125, I-131, Yb-169, Ir-192 as a solid source, I-125 as a solid source, or other radionuclides that emit photons, beta particles, gamma radiation, or other therapeutic rays. The radioactive material can also be a fluid made from any solution of radionuclide(s), e.g., a solution of I-125 or I-131, or a radioactive fluid can be produced using a slurry of a suitable fluid containing small particles of solid radionuclides, such as Au-198, Y-90.

ENTPD2 blockade may also be effectively combined with chemotherapeutic regimes. In these instances, it may be possible to reduce the dose of chemotherapeutic reagent administered.

Exemplary cytotoxic agents that can be administered in combination with an anti-human ENTPD2 antibody molecule include antimicrotubule agents, topoisomerase inhibitors, anti-metabolites, mitotic inhibitors, alkylating agents, anthracyclines, vinca alkaloids, intercalating agents, agents capable of interfering with a signal transduction pathway, agents that promote apoptosis, proteosome inhibitors, and radiation (e.g., local or whole body irradiation).

Sample Preparation

Samples used in the methods described herein can be obtained from a subject using any one of the methods known in the art, e.g., by biopsy or surgery. The sample may be flash frozen and stored at −80° C. for later use. The sample may also be fixed with a fixative, such as formaldehyde, paraformaldehyde, or acetic acid/ethanol. RNA or protein may be extracted from a fresh, frozen or fixed sample for analysis.

Pharmaceutical Compositions, Dosage, and Methods of Administration

Also provided herein are compositions, e.g., pharmaceutical compositions, for use in treatment of a ENTPD2-associated disease, e.g., a cancer as described herein. Such compositions include one or more antibodies or antigen binding fragments described herein, nucleic acids encoding such antibodies or antigen binding fragments, or vectors comprising a nucleic acid encoding such antibodies or antigen binding fragments. Such compositions can further include another agent, e.g., a current standard of care for the disease to be treated.

Pharmaceutical compositions typically include a pharmaceutically acceptable carrier. As used herein the language "pharmaceutically acceptable carrier" includes saline, solvents, dispersion media, coatings, antibacterial and antifungal agents, isotonic and absorption delaying agents, and the like, compatible with pharmaceutical administration. Pharmaceutical compositions are typically formulated to be compatible with its intended route of administration. Examples of routes of administration include parenteral (e.g., intravenous, intraarterial, intraperitoneal), intracranial, intrathecal, or intranasal (e.g., inhalation), intradermal, subcutaneous, or intratumor administration.

The phrase "pharmaceutically acceptable" is employed herein to refer to those compounds, materials, compositions, and/or dosage forms which are, within the scope of sound medical judgment, suitable for use in contact with the tissues of human beings and animals without excessive toxicity, irritation, allergic response, or other problem or complication, commensurate with a reasonable benefit/risk ratio.

In some embodiments, the pharmaceutical compositions comprise one or more pharmaceutically acceptable carriers, including, e.g., ion exchangers, alumina, aluminum stearate, lecithin, serum proteins, such as human serum albumin, buffer substances such as phosphates, glycine, sorbic acid, potassium sorbate, partial glyceride mixtures of saturated vegetable fatty acids, water, salts or electrolytes, such as protamine sulfate, disodium hydrogen phosphate, potassium hydrogen phosphate, sodium chloride, zinc salts, colloidal silica, magnesium trisilicate, polyvinyl pyrrolidone, cellulose-based substances, polyethylene glycol, sodium carboxymethylcellulose, polyacrylates, waxes, polyethylene-polyoxypropylene-block polymers, polyethylene glycol, and wool fat.

Methods of formulating suitable pharmaceutical compositions are known in the art, see, e.g., Remington: The Science and Practice of Pharmacy. 21st ed., 2005; and the books in the series Drugs and the Pharmaceutical Sciences: a Series of Textbooks and Monographs (Dekker, NY). For example, solutions or suspensions used for parenteral or subcutaneous application can include the following components: a sterile diluent such as water for injection, saline solution, fixed oils, polyethylene glycols, glycerin, propylene glycol or other synthetic solvents; antibacterial agents such as benzyl alcohol or methyl parabens; antioxidants such as ascorbic acid or sodium bisulfate; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The preparation can be enclosed in ampoules, disposable syringes or multiple dose vials made of glass or plastic.

Pharmaceutical compositions suitable for injectable use can include sterile aqueous solutions (where water soluble) or dispersions and sterile powders, for the extemporaneous preparation of sterile injectable solutions or dispersion. For intravenous administration, suitable carriers include physiological saline, bacteriostatic water, Cremophor EL™ (BASF, Parsippany, NJ) or phosphate buffered saline (PBS). In all cases, the composition must be sterile and should be fluid to the extent that easy syringability exists. It should be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyethylene glycol, and the like), and suitable mixtures thereof. The proper fluidity can be maintained, for example, by the use of a coating such as lecithin, by the maintenance of the required particle size in the case of dispersion and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization.

Generally, dispersions are prepared by incorporating the active compound into a sterile vehicle, which contains a basic dispersion medium and the required other ingredients from those enumerated above. In the case of sterile powders for the preparation of sterile injectable solutions, the preferred methods of preparation are vacuum drying and freeze-drying, which yield a powder of the active ingredient plus any additional desired ingredient from a previously sterile-filtered solution thereof.

Parenteral formulations can be a single bolus dose, an infusion or a loading bolus dose followed with a maintenance dose. These compositions can be administered at specific fixed or variable intervals, e.g., once a day, or on an "as needed" basis.

A suitable pharmaceutical composition for injection can comprise a buffer (e.g., acetate, phosphate or citrate buffer), a surfactant (e.g., polysorbate), optionally a stabilizer agent (e.g., human albumin), etc. Preparations for peripheral administration include sterile aqueous or non-aqueous solutions, suspensions, and emulsions. Examples of non-aqueous solvents are propylene glycol, polyethylene glycol, vegetable oils such as olive oil, and injectable organic esters such as ethyl oleate. Aqueous carriers include, e.g., water, alcoholic/aqueous solutions, emulsions or suspensions, including saline and buffered media. In some embodiments, the pharmaceutical composition comprises 0.01-0.1 M phosphate buffer or 0.8% saline. Other common parenteral vehicles include sodium phosphate solutions, Ringer's dextrose, dextrose and sodium chloride, lactated Ringer's, or fixed oils. Intravenous vehicles include fluid and nutrient replenishers, electrolyte replenishers, such as those based on Ringer's dextrose, and the like. Preservatives and other additives can also be present such as, for example, antimicrobials, antioxidants, chelating agents, and inert gases and the like.

In one embodiment, the therapeutic compounds are prepared with carriers that will protect the therapeutic compounds against rapid elimination from the body, such as a controlled release formulation, including implants and microencapsulated delivery systems.

The pharmaceutical compositions can be included in a container, pack, or dispenser together with instructions for administration.

Dosage, toxicity and therapeutic efficacy of the therapeutic compounds can be determined by standard pharmaceutical procedures in cell cultures or experimental animals, e.g., for determining the LD50 (the dose lethal to 50% of the population) and the ED50 (the dose therapeutically effective in 50% of the population). The dose ratio between toxic and therapeutic effects is the therapeutic index and it can be expressed as the ratio LD50/ED50. Compounds which exhibit high therapeutic indices are preferred. While compounds that exhibit toxic side effects may be used, care should be taken to design a delivery system that targets such compounds to the site of affected tissue in order to minimize potential damage to uninfected cells and, thereby, reduce side effects.

The data obtained from cell culture assays and animal studies can be used in formulating a range of dosage for use in humans. The dosage of such compounds lies preferably within a range of circulating concentrations that include the ED50 with little or no toxicity. The dosage may vary within this range depending upon the dosage form employed and the route of administration utilized. For any compound used in the method of the invention, the therapeutically effective dose can be estimated initially from cell culture assays. A dose may be formulated in animal models to achieve a circulating plasma concentration range that includes the IC50 (i.e., the concentration of the test compound which achieves a half-maximal inhibition of symptoms) as determined in cell culture. Such information can be used to more accurately determine useful doses in humans. Levels in plasma may be measured, for example, by high performance liquid chromatography.

Kits

Also provided herein are kits including one or more of the compositions provided herein and instructions for use. Instructions for use can include instructions for diagnosis or treatment of a ENTPD2-associated disease, e.g., a cancer, as described herein. Kits as provided herein can be used in accordance with any one of the methods described herein. Those skilled in the art will be aware of other suitable uses for kits provided herein, and will be able to employ the kits for such uses. Kits as provided herein can also include a mailer (e.g., a postage paid envelope or mailing pack) that can be used to return the sample for analysis, e.g., to a laboratory. The kit can include one or more containers for the sample, or the sample can be in a standard blood collection vial. The kit can also include one or more of an informed consent form, a test requisition form, and instructions on how to use the kit in a method described herein. Methods for using such kits are also included herein. One or more of the forms (e.g., the test requisition form) and the container holding the sample can be coded, for example, with a bar code for identifying the subject who provided the sample.

One skilled in the art will recognize many methods and materials similar or equivalent to those described herein, which could be used in the practice of the present invention. Indeed, the present invention is in no way limited to the methods and materials described.

EXAMPLES

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations. The invention is further described in the following examples, which do not limit the scope of the invention described in the claims.

Example 1: Expression of ENTPD2 in Cancer

Ectonucleoside triphosphate diphosphohydrolase 2 (also referred to as ENTPD2, NTPDase 2, NTPDase-2, Ecto-ATPase 2, Ecto-ATPDase 2, CD39 Antigen-like 1, CD39L1, ecto-ATP-Diphosphohydrolase 2) belongs to a family of extracellular ATP hydrolases that regulate purinergic signaling, specifically ATP, UTP, as well as ADP and UDP in the extracellular space (for review see Robson et al Purinergic Signaling 2:409-430 (2006)). End product of ATP/ADP hydrolysis 5'AMP is subsequently dephosphorylated to adenosine by the ecto-5'-nucleotidase (also known as Ecto5'Ntase or CD73).

The functional role of ENTPD2 in cancer has not been well described. Early reports focused on ENTPD2 overexpression in a rat glioma model which led to enhanced in vivo tumor growth through ADP-mediated modulation of platelets and the tumor microenvironment, as well as promoted an inflammatory state potentiating tumor spread (Braganhol et al Cancer Sci 100(8): 1434-42 (2009); Braganhol et al Purinergic Signal 8(2):235-43 (2012)). More recently elevated expression of ENTPD2 was reported in hepatocellular carcinoma, where its expression was associated with worse prognosis due to enhanced myeloid-derived suppressor cell accumulation/maintenance (Chiu et al Nature Communications 8(1): 517 (2017)).

Although the functional characterization of ENTPD2 in cancer is limited in the public domain, the purinergic mediators such as ATP and adenosine, released into the extracellular space, have been shown to play important role in immunity and inflammation. ATP released from stressed, damaged or apoptotic cells triggers rapid inflammation via activation of P2RX and P2RY receptors that enhance recruitment of immune cells, potentiate TCR signaling in T cells and promote dendritic and macrophage cell activation. On the other hand, adenosine signaling results in an immunosuppressive niche through inhibition of effector T cells, as well as deregulation of mononuclear phagocyte cells (for reviews see Cekic et al Nature Reviews Immunology 16: 177-192 (2016), Antonioli et al Nature Reviews Cancer 13: 842-857 (2013)). Pre-clinically blockade of adenosine signaling or restoration of extracellular ATP at the tumor site have demonstrated to induce lymphocyte recruitment and anti-tumor responses (Michaud et al Science 334(6062): 1573-7 (2011); Allard et al Clinical Cancer Research 19(20): 5626-35 (2013)).

Elevated expression of ENTPD2 in cancer cells has the potential to dramatically alter the balance of purinergic signaling in the tumor microenvironment, shifting it towards a more immunosuppressive state. Targeted inhibition of ENTPD2 catalytic function can therefore provide an opportunity to shift the balance towards an ATP-driven pro-inflammatory Th-1 like state, potentiating anti-tumor immune response.

ENTPD2 expression has not been carefully examined across different tumor subtypes. Anti-human ENTPD2 mAb1 was used to assess ENTPD2 expression across cancer cell lines from different indications. Cells were stained with Anti-human ENTPD2 mAb1 at 5 µg/ml for 45 min on ice, followed by an incubation with goat anti-human IgG, Fcγ specific, Alexa Fluor 647 or APC conjugated secondary Ab (1:400 dilution; Jackson ImmunoResearch Laboratories, West Grove, PA). All incubations and washes were performed in FACS Buffer composed of 1× HyClone Phosphate Buffered Saline (GE Healthcare, Pittsburgh, PA), 1% HyClone Fetal Bovine Serum (GE Healthcare, Pittsburgh, PA), 2 mM EDTA (ThermoFisher, Waltham MA).

Elevated expression of ENTPD2 was observed in representative cancer cell lines from colorectal, esophageal, gastric, breast and lung cancer indications as shown in FIG. 1A. ENTPD2 receptor density was quantified using the Quantum Simply Cellular anti-Human IgG from Bangs Laboratories (Fishers, IN) according to manufacturer's directions (Table 20, FIG. 1B).

In order to assess ENTPD2 protein expression in primary tumor tissues, formalin-fixed paraffin-embedded tumor tissue microarrays with matched adjacent normal tissues were obtained from Cureline (Brisbane, CA). IHC staining was performed with the anti-CD39L1/ENTPD2 IHC Ab (NBP1-85752, Novus, Littleton, CO) using an automated Ventana protocol with standard high pH CC1 antigen retrieval at 95° C., and followed by incubations with Ventana DISCOVERY® OmniMap anti-Rb HRP secondary Ab and Ventana DISCOVERY® ChromoMap DAB Kit (Ventana, Tucson AZ).

Figure 2:
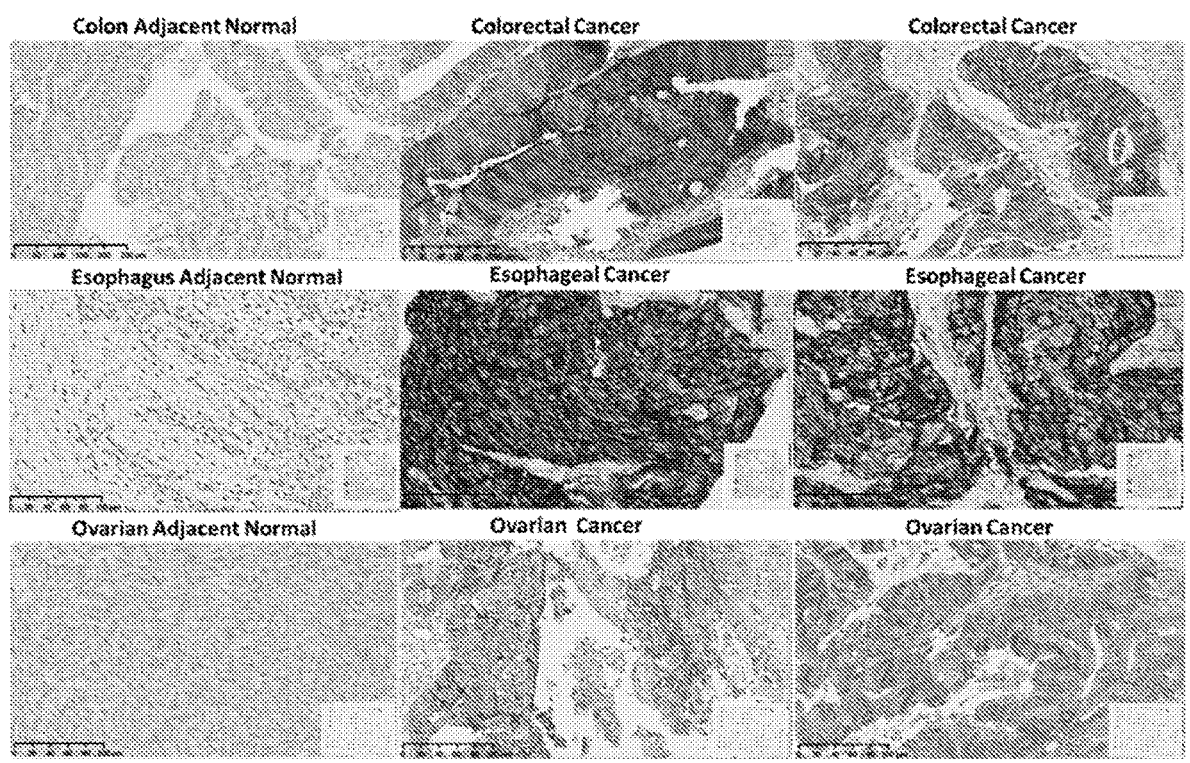
FIG. 2 depicts representative IHC staining images of ENTPD2 in formalin-fixed paraffin-embedded primary colorectal, esophageal and ovarian tumor tissues.
Figure 5A:
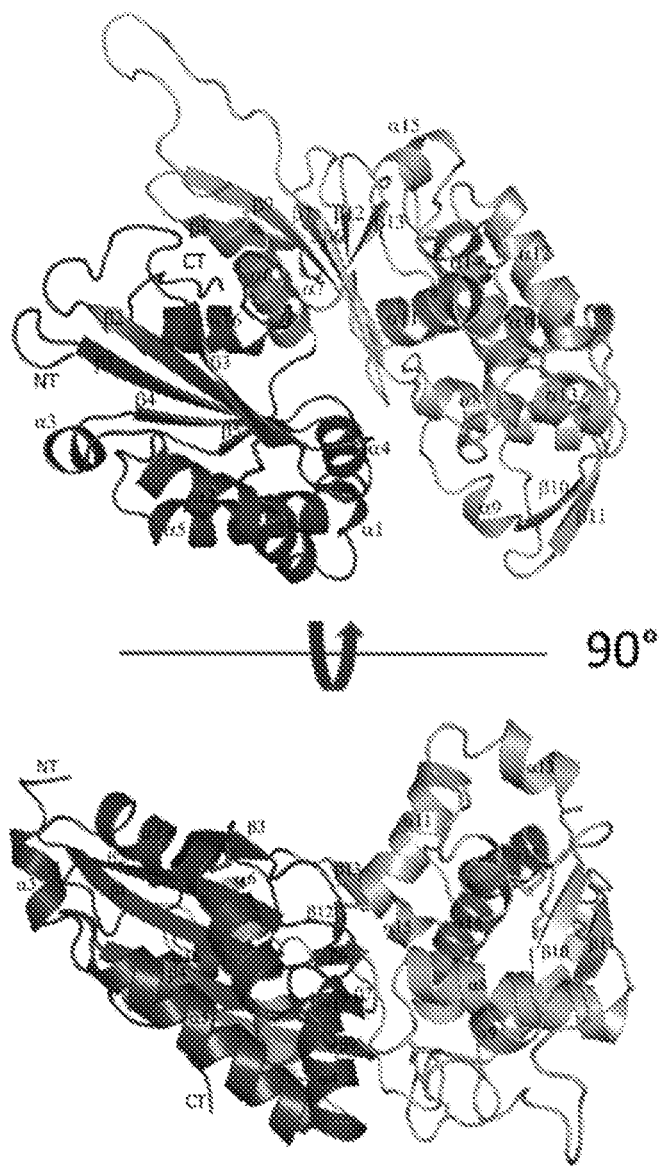
FIG. 5A shows a cartoon depiction of the human ENTPD2 ectodomain apo crystal structure with residues 33-453 shown. Two views are rotated by 90 degrees. Consecutive secondary structural elements are labeled. Disulfides are shown as sticks. The amino- and carboxy-termini are labeled NT and CT, respectively. The membrane proximal lobe contains both N- and C-termini (subdomain1: Pro36-Ser161 and Lys427-Phe461) and is shaded darker than the membrane distal lobe (subdomain 2: Gly162-Gln426). Substrate ATP binds deep within the interlobe cleft. The location of the ATP binding site is illustrated in FIG. 5B. Shown is the ATP analog AMP-PNP superposed in the human ENTPD2 active site from the rat ENTPD2 co-structure (PDB 3CJA).
Figure 5B:

Elevated ENTPD2 expression, localized to the cell membrane, was observed in subsets of colorectal, esophageal and ovarian tumor samples. None or very low background levels of ENTPD2 expression was detected in the matched normal tissue sections (FIG. 2).

Example 2: Generation of Humanized Monoclonal Antibodies that Bind to Human ENTPD2

Generation of Expression Constructs for Human, Rat, Mouse and Cynomolgus Monkey ENTPD2

Nucleotide sequences encoding full-length ENTPD2 from human, cynomolgus macaque (cyno), rat and mouse as well as ENTPD1 (CD39) from human and mouse were synthesized based on amino acid sequences from the GenBank® or UniProtKB databases (see Table 24). All synthesized DNA fragments were cloned into appropriate expression vectors.

TABLE 24

| Sequences of reagents used for generating anti-ENTPD2 antibody | |
|---|---|
| Human ENTPD2: NP_982293 | |
| SEQ ID NO: 291 | MAGKVRSLLPPLLLAAAGLAGLLLLCVPTRDVREPPALKYGIVL<br>DAGSSHTSMFIYKWPADKENDTGIVGQHSSCDVPGGGISSYADN<br>PSGASQSLVGCLEQALQDVPKERHAGTPLYLGATAGMRLLNLTN<br>PEASTSVLMAVTHTLTQYPFDFRGARILSGQEEGVFGWVTANYL<br>LENFIKYGWVGRWFRPRKGTLGAMDLGGASTQITFETTSPAEDR<br>ASEVQLHLYGQHYRVYTHSFLCYGRDQVLQRLLASALQTHGFH<br>PCWPRGFSTQVLLGDVYQSPCTMAQRPQNFNSSARVSLSGSSDP<br>HLCRDLVSGLFSFSSCPFSRCSFNGVFQPPVAGNFVAFSAFFYTVD<br>FLRTSMGLPVATLQQLEAAAVNVCNQTWAQLQARVPGQRARLA<br>DYCAGAMFVQQLLSRGYGFDERAFGGVIFQKKAADTAVGWAL<br>GYMLNLTNLIPADPPGLRKGTDFSSWVVLLLLFASALLAALVLLL<br>RQVHSAKLPSTI |
| SEQ ID NO: 342 | ATGGCCGGGAAGGTGCGGTCACTGCTGCCGCCGCTGCTGCTG<br>GCCGCCGCGGGCCTCGCCGGCCTCCTACTGCTGTGCGTCCCCA<br>CCCGCGACGTCCGGGAGCCGCCCGCCCTCAAGTATGGCATCGT<br>CCTGGACGCTGGTTCTTCACACACGTCCATGTTTATCTACAAG<br>TGGCCGGCAGACAAGGAGAACGACACAGGCATTGTGGGCCAG<br>CACAGCTCCTGTGATGTTCCAGGTGGGGGCATCTCCAGCTATG<br>CAGACAACCCTTCTGGGGCCAGCCAGAGTCTTGTTGGATGCCT<br>CGAACAGGCGCTTCAGGATGTGCCCAAAGAGAGACACGCGGG<br>CACACCCCTCTACCTGGGAGCCACAGCGGGTATGCGCCTGCTC<br>AACCTGACCAATCCAGAGGCCTCGACCAGTGTGCTCATGGCA<br>GTGACTCACACACTGACCCAGTACCCCTTTGACTTCCGGGGTG<br>CACGCATCCTCTCGGGCCAGGAAGAGGGGGTGTTTGGCTGGG<br>TGACTGCCAACTACCTGCTGGAGAACTTCATCAAGTACGGCTG<br>GGTGGGCCGGTGGTTCCGGCCACGGAAGGGGACACTGGGGGC<br>CATGGACCTGGGGGGTGCCTCTACCCAGATCACTTTTGAGACA<br>ACCAGTCCAGCTGAGGACAGAGCCAGCGAGGTCCAGCTGCAT<br>CTCTACGGCCAGCACTACCGAGTCTACACCCACAGCTTCCTCT<br>GCTATGGCCGTGACCAGGTCCTCCAGAGGCTGCTGGCCAGCG<br>CCCTCCAGACCCACGGCTTCCACCCCTGCTGGCCGAGGGGCTT<br>TTCCACCCAAGTGCTGCTCGGGGATGTGTACCAGTCACCATGC<br>ACCATGGCCCAGCGGCCCAGAACTTCAACAGCAGTGCCAGG<br>GTCAGCCTGTCAGGGAGCAGTGACCCCCACCTCTGCCGAGATC<br>TGGTTTCTGGGCTCTTCAGCTTCTCCTCCTGCCCCTTCTCCCGA<br>TGCTCTTTCAATGGGGTCTTCCAGCCCCCAGTGGCTGGGAACT<br>TTGTGGCCTTCTCTGCCTTCTTCTACACTGTGGACTTTTTGCGG<br>ACTTCGATGGGGCTGCCCGTGGCCACCCTGCAGCAGCTGGAG<br>GCAGCCGCAGTGAATGTCTGCAACCAGACCTGGGCTCAGCTG<br>CAAGCTCGGGTGCCAGGGCAACGGGCCCGCCTGGCCGACTAC<br>TGCGCCGGGGCCATGTTCGTGCAGCAGCTGCTGAGTCGCGGCT<br>ACGGCTTCGACGAGCGCGCCTTCGGCGGCGTGATCTTCCAGAA<br>GAAGGCCGCGGACACTGCAGTGGGCTGGGCGCTCGGCTACAT<br>GCTGAACCTGACCAACCTGATCCCCGCCGACCCGCCGGGGCT<br>GCGCAAGGGCACAGACTTCAGCTCCTGGGTCGTCCTCCTGCTG<br>CTCTTCGCCTCCGCGCTCCTGGCTGCGCTTGTCCTGCTGCTGCG<br>TCAGGTGCACTCCGCCAAGCTGCCAAGCACCATT |
| CynoENTPD2: XP_005580409 | |
| SEQ ID NO: 343 | MAGKVRSLLPPLLLAAAGLAGLLLLCVPTRDIREPPALKYGIVLD<br>AGSSHTSMFIYKWPADKENDTGIVGQHSSCDVPGGGISSYADNPS<br>GAGQSLVGCLEQALRDVPKERHAGTPLYLGATAGMRLLNLTNP<br>EASTSVLTAVTHTLTQYPFDFRGARILSGQEEGVFGWVTANYLLE<br>NFIKYGWVGRWFRPRKGTLGAMDLGGASTQITFETTSPAEDRAS<br>EVQLRLYGQHYRVYTHSFLCYGRDQVLQRLLASALQTHSFHPC |

TABLE 24-continued

Sequences of reagents used for generating anti-ENTPD2 antibody

| | |
|---|---|
| | WPRGFSTHVLLGDVYQSPCTVAQRPQTFNSSARVSLSGSSDPHLC<br>RDLVSGLFSFSSCPFSRCSFNGVFQPPVAGNFIAFSAFFYTVNFLRT<br>SMGLPVATLQQLEAAAVNVCNQTWAQLQARVPGQQAHLADYC<br>AGAMFVQQLLSRGYGFDERAFGGVIFQKKAADTAVGWALGYM<br>LNLTNLIPADPPGLRKGTDFSSWVVLLLLFASALLAALVLLLHQV<br>HSAKLPSTI |
| SEQ ID NO: 344 | ATGGCCGGGAAGGTGCGGTCACTGCTGCCGCCGCTGCTGCTG<br>GCCGCCGCGGGCCTCGCCGGCCTCCTACTGCTGTGCGTGCCCA<br>CCAGGGACATTAGGGAGCCTCCCGCTCTGAAATACGGCATCG<br>TGCTGGACGCCGGAAGCAGCCACACCTCCATGTTCATCTACAA<br>GTGGCCCGCCGACAAGGAGAACGACACAGGCATCGTGGGCCA<br>GCATAGCTCCTGCGACGTGCCTGGAGGCGGCATCTCCAGCTAC<br>GCCGACAATCCTTCCGGCGCTGGACAGTCCCTGGTGGGATGTC<br>TGGAGCAGGCCCTGAGGGACGTGCCTAAGGAGAGACACGCCG<br>GCACCCCTCTGTACCTGGGAGCCACAGCCGGCATGAGACTCCT<br>GAATCTGACCAACCCTGAGGCCTCCACCTCCGTCCTGACAGCC<br>GTGACACATACCCTGACCCAGTACCCCTTCGATTTCAGGGGAG<br>CCAGAATACTGAGCGGCCAGGAAGAAGGCGTGTTCGGATGGG<br>TGACCGCCAACTACCTCCTGGAGAACTTCATCAAGTACGGCTG<br>GGTGGGCAGGTGGTTTAGACCCAGGAAGGGCACCCTGGGAGC<br>TATGGATCTGGGCGGAGCTTCCACACAGATCACCTTCGAGACC<br>ACCTCCCCCGCTGAGGACAGAGCCTCCGAGGTGCAGCTGAGG<br>CTGTACGGCCAGCATTACAGGGTGTATACACACAGCTTCCTGT<br>GCTACGGCAGGGACCAGGTCCTGCAGAGACTGCTCGCTTCCG<br>CCCTGCAGACCCACTCCTTCCACCCTTGCTGGCCTAGGGGCTT<br>TAGCACCCATGTGCTCCTGGGAGATGTGTACCAGAGCCCCTGC<br>ACCGTGGCCCAAAGACCCCAGACCTTTAACTCCTCCGCTAGAG<br>TGAGCCTGAGCGGCAGCTCCGATCCCCACCTGTGTAGGGACCT<br>GGTCAGCGGACTGTTCAGCTTCAGCAGCTGCCCTTTCAGCAGG<br>TGCAGCTTCAATGGCGTGTTCCAGCCTCCCGTGGCCGGCAACT<br>TCATCGCTTTCTCCGCCTTCTTCTACACCGTCaACTTTCTGAGG<br>ACAAGCATGGGACTGCCCGTGGCTACCCTCCAACAACTGGAG<br>GCCGCCGCCGTGAACGTGTGCAACCAGACATGGGCCCAACTG<br>CAGGCTAGGGTGCCCGGCCAACAGGCCCATCTGGCTGACTAC<br>TGTGCCGGCGCCATGTTCGTGCAGCAGCTGCTGAGCAGGGGCT<br>ATGGATTCGACGAGAGGGCCTTCGGCGGCGTCATCTTCCAAA<br>AGAAGGCCGCCGATACAGCCGTGGGCTGGGCTCTGGGCTACA<br>TGCTGAACCTGACAAACCTGATCCCCGCTGACCCCCCCGGACT<br>GAGGAAGGGAACCGATTTCAGCAGCTGGGTCGTGCTCCTGCT<br>GCTGTTTGCTAGCGCCCTGCTCGCCGCTCTGGTGCTGCTGCTG<br>CACCAGGTGCACTCCGCCAAGCTGCCCAGCACCATT |
| Mouse ENTPD2:<br>NP_033979 | |
| SEQ ID NO: 345 | MAGKLVSLVPPLLLAAVGLAGLLLLCVPTQDVREPPALKYGIVL<br>DAGSSHTSMFVYKWPADKENDTGIVGQHSSCDVRGGGISSYAN<br>DPSRAGQSLVECLEQALRDVPKDRYASTPLYLGATAGMRLLNLT<br>SPEATAKVLEAVTQTLTRYPFDFRGARILSGQDEGVFGWVTANY<br>LLENFIKYGWVGRWIRPRKGTLGAMDLGGASTQITFETTSPSEDP<br>DNEVHLRLYGQHYRVYTHSFLCYGRDQVLQRLLASALQIHRFHP<br>CWPKGYSTQVLLREVYQSPCTMGQRPQTFNSSATVSLSGTSNAA<br>LCRDLVSGLFNISSCPFSQCSFNGVFQPPVAGNFIAFSAFYYTVDF<br>LKTVMGLPVGTLKQLEDATETTCNQTWAELQARVPGQQTRLPD<br>YCAVAMFIHQLLSRGYRFDERSFRGVVFEKKAADTAVGWALGY<br>MLNLTNLIPADLPGLRKGTHFSSWVALLLLFTVLILAALVLLLRQ<br>VRSAKSPGAL |
| SEQ ID NO: 346 | ATGGCTGGAAAGTTGGTGTCACTGGTGCCACCCCTGCTGCTGG<br>CTGCCGTGGGCCTCGCCGGCCTCCTGCTACTGTGCGTGCCCTAC<br>CCAAGACGTCCGGGAGCCGCCCGCCCTCAAGTATGGCATCGTT<br>CTGGATGCTGGCTCTTCACACACATCCATGTTTGTCTACAAGT<br>GGCCAGCGGACAAGGAAAATGACACAGGTATCGTGGGCCAGC<br>ACAGCTCTTGCGATGTTCGAGGTGGTGGCATCTCCAGCTACGC<br>AAATGACCCTTCTAGGGCAGGCCAGAGTCTGGTTGAATGTCTT<br>GAACAGGCACTTCGGGATGTGCCCAAAGACAGATATGCCAGC<br>ACTCCACTCTACCTGGGAGCTACAGCAGGCATGCGCCTACTCA<br>ACCTGACCAGCCCAGAGGCCACAGCCAAGGTGCTGGAGGCAG<br>TGACACAGACGCTCACACGGTACCCCTTTGACTTCCGTGGTGC<br>CCGCATCCTCTCGGGACAGGATGAAGGGGTGTTTGGCTGGGT<br>GACTGCCAACTACCTGCTGGAGAACTTCATCAAGTATGGCTGG<br>GTAGGCCGGTGGATACGGCCAAGGAAGGGAACTCTGGGGGCC<br>ATGGACCTTGGGGGTGCCTCAACACAGATCACCTTTGAGACA<br>ACCAGTCCATCTGAAGATCCAGATAATGAGGTCCATTTGCGGC<br>TCTATGGCCAGCATTACCGTGTCTACACCCATAGCTTCCTCTG<br>CTATGGCCGGGACCAGGTTCTCCAGAGGCTTCTGGCCAGTGCC<br>CTCCAGATCCATCGCTTCCACCCCTGCTGGCCAAAGGGCTACT |

TABLE 24-continued

Sequences of reagents used for generating anti-ENTPD2 antibody

```
            CCACCCAAGTGCTGCTCCGGGAAGTCTACCAGTCTCCATGCAC
            TATGGGTCAGCGTCCCCAGACCTTCAACAGCAGTGCCACTGTC
            AGCCTGTCAGGGACCAGCAACGCTGCCCTCTGTCGTGACCTCG
            TCTCTGGGCTCTTCAATATCTCCTCCTGTCCCTTTTCCCAATGC
            TCCTTCAATGGGGTTTTCCAGCCTCCCGTGGCTGGGAACTTCA
            TAGCCTTTTCTGCTTTCTACTATACTGTAGACTTCCTGAAGACA
            GTGATGGGGCTGCCTGTGGGAACCCTGAAGCAGCTGGAGGAT
            GCCACAGAGACCACCTGCAACCAGACCTGGGCTGAGCTTCAG
            GCCCGAGTACCCGGACAGCAGACCCGCCTGCCTGACTACTGC
            GCTGTAGCCATGTTCATACATCAGCTATTGAGCCGCGGTTATC
            GCTTCGACGAGCGCTCTTTCCGTGGAGTGGTCTTCGAAAAGAA
            GGCGGCAGACACGGCTGTCGGCTGGGCGCTGGGCTACATGCT
            GAATTTGACCAACCTGATTCCCgctgacctcccgggactacgta
            agggcacccacTTCAGCTCCTGGGTTGCTCTCCTGCTGCTCTTC
            ACAGTCCTGATCTTGGCGGCTTTGGTCCTGCTCTTGCGCCAGGT
            GCGCTCTGCCAAGTCCCCAGGCGCCCTC
```

RatENTPD2: NP_742027

SEQ ID NO: 347
```
MAGKLVSLVPPLLLAAAGLAGLLLLCVPTQDVREPPALKYGIVL
DAGSSHTSMFVYKWPADKENDTGIVGQHSSCDVQGGGISSYAN
DPSKAGQSLVRCLEQALRDVPRDRHASTPLYLGATAGMRLLNLT
SPEATARVLEAVTQTLTQYPFDFRGARILSGQDEGVFGWVTANY
LLENFIKYGWVGRWIRPRKGTLGAMDLGGASTQITFETTSPSEDP
GNEVHLRLYGQHYRVYTHSFLCYGRDQILLRLLASALQIHRFHPC
WPKGYSTQVLLQEVYQSPCTMGQRPRAFNGSAIVSLSGTSNATL
CRDLVSRLFNISSCPFSQCSFNGVFQPPVTGNFIAFSAFYYTVDFLT
TVMGLPVGTLKQLEEATEITCNQTWTELQARVPGQKTRLADYC
AVAMFIHQLLSRGYHFDERSFREVVFQKKAADTAVGWALGYML
NFTNLIPADLPGLRKGTHFSSWVALLLLFTVLILAALVLLLRQVRS
AKSPGAL
```

SEQ ID NO: 348
```
ATGGCTGGAAAGTTGGTGTCACTGGTGCCACCCCTGCTGCTGG
CTGCCGcGGGCCTCGCCGGCCTCCTGCTACTGTGCGTCCCTACC
CAAGACGTCCGGGAGCCGCCCGCCCCTCAAGTATGGCATCGTTC
TGGATGCTGGCTCTTCACACACATCCATGTTTGTCTACAAGTG
GCCAGCGGACAAGGAAAATGACACAGGTATCGTGGGCCAGCA
CAGCTCCTGCGATGTGCAGGGCGGCGGCATTTCCAGCTATGCC
AACGACCCCTCCAAAGCCGGACAGTCCCTGGTCAGGTGCCTG
GAGCAGGCCCTGAGAGACGTCCCCAGAGACAGACACGCGAGC
ACCCCTCTGTATCTCGGCGCCACAGCCGGCATGAGGCTGCTGA
ACCTGACCTCCCCTGAGGCCACAGCCAGAGTCCTGGAGGCTGT
CACCCAGACCCTGACACAGTACCCCTTCGACTTTAGGGGCGCC
AGAATACTGTCCGGCCAGGATGAAGGCGTGTTCGGCTGGGTG
ACAGCCAACTACCTGCTGGAGAACTTTATTAAGTACGGCTGGG
TGGGCAGATGGATCAGGCCCAGGAAGGGCACCCTGGGAGCCA
TGGATCTCGGCGGAGCCTCCACCCAGATCACCTTTGAGACCAC
CAGCCCCTCCGAAGACCCGGGCAATGAGGTCCACCTGAGGCT
GTACGGCCAGCACTATAGAGTCTACACCCACAGCTTCCTGTGC
TACGGCAGAGATCAAATCCTGCTGAGACTGCTCGCTTCCGCCC
TGCAGATTCATAGGTTTCACCCCTGCTGGCCCAAAGGCTACAG
CACCCAGGTGCTGCTCCAAGAGGTGTACCAGAGCCCTTGCACC
ATGGGACAGAGACCCAGGGCTTTCAACGGAAGCGCCATCGTG
TCCCTCAGCGGCACCAGCAACGCCACCCTGTGTAGGGACCTCG
TGAGCAGACTGTTCAACATCTCCTCCTGCCCTTTCAGCCAGTG
TTCCTTCAATGGCGTGTTTCAGCCCCCTGTGACAGGCAACTTC
ATCGCCTTCAGCGCTTTCTACTACACCGTGGACTTTCTCACAA
CCGTCATGGGCCTGCCCGTGGGAACCCTGAAGCAACTGGAGG
AAGCCACCGAGATCACCTGCAACCAGACCTGGACCGAACTGC
AAGCCAGGGTGCCCGGCCAGAAGACCAGACTGGCCGACTACT
GTGCTGTCGCCATGTTCATTCACCAACTGCTGAGCAGGGGCTA
CCACTTCGATGAAAGGAGCTTCAGGGAGGTGGTGTTCCAGAA
GAAGGCCGCCGATACCGCTGTGGGCTGGGCTCTGGGCTACAT
GCTCAACTTCACCAACCTGATCCCCgccgatctccccggactga
ggaagggaacccacTTCAGCTCCTGGGTTGCTCTCCTGCTGCTC
TTCACAGTCCTGATCTTGGCGGCTTTGGTCCTGCTCTTGCGCCA
GGTGCGCTCTGCCAAGTCCCCAGGCGCCCTC
```

HumanENTPD1: NP_001767

SEQ ID NO: 349
```
MEDTKESNVKTFCSKNILAILGFSSIIAVIALLAVGLTQNKALPEN
VKYGIVLDAGSSHTSLYIYKWPAEKENDTGVVHQVEECRVKGPG
ISKFVQKVNEIGIYLTDCMERAREVIPRSQHQETPVYLGATAGMR
LLRMESEELADRVLDVVERSLSNYPFDFQGARIITGQEEGAYGWI
TINYLLGKFSQKTRWFSIVPYETNNQETFGALDLGGASTQVTFVP
QNQTIESPDNALQFRLYGKDYNVYTHSFLCYGKDQALWQKLAK
DIQVASNEILRDPCFHPGYKKVVNVSDLYKTPCTKRFEMTLPFQQ
```

TABLE 24-continued

Sequences of reagents used for generating anti-ENTPD2 antibody

|  |  |
|---|---|
|  | FEIQGIGNYQQCHQSILELFNTSYCPYSQCAFNGIFLPPLQGDFGA<br>FSAFYFVMKFLNLTSEKVSQEKVTEMMKKFCAQPWEEIKTSYAG<br>VKEKYLSEYCFSGTYILSLLLQGYHFTADSWEHIHFIGKIQGSDAG<br>WTLGYMLNLTNMIPAEQPLSTPLSHSTYVFLMVLFSLVLFTVAII<br>GLLIFHKPSYFWKDMV |
| SEQ ID NO: 350 | ATGGAAGATACAAAGGAGTCTAACGTGAAGACATTTTGCTCC<br>AAGAATATCCTAGCCATCCTTGGCTTCTCCTCTATCATAGCTGT<br>GATAGCTTTGCTTGCTGTGGGGTTGACCCAGAACAAAGCATTG<br>CCAGAAAACGTTAAGTATGGGATTGTGCTGGATGCGGGTTCTT<br>CTCACACAAGTTTATACATCTATAAGTGGCCAGCAGAAAAGG<br>AGAATGACACAGGCGTGGTGCATCAAGTAGAAGAATGCAGGG<br>TTAAAGGTCCTGGAATCTCAAAATTTGTTCAGAAAGTAAATGA<br>AATAGGCATTTACCTGACTGATTGCATGGAAAGAGCTAGGGA<br>AGTGATTCCAAGGTCCCAGCACCAAGAGACACCCGTTTACCTG<br>GGAGCCACGGCAGGCATGCGGTTGCTCAGGATGGAAAGTGAA<br>GAGTTGGCAGACAGGGTTCTGGATGTGGTGGAGAGGAGCCTC<br>AGCAACTACCCCTTTGACTTCCAGGGTGCCAGGATCATTACTG<br>GCCAAGAGGAAGGTGCCTATGGCTGGATTACTATCAACTATCT<br>GCTGGGCAAATTCAGTCAGAAAACAAGGTGGTTCAGCATAGT<br>CCCATATGAAACCAATAATCAGGAAACCTTTGGAGCTTTGGAC<br>CTTGGGGAGCCTCTACACAAGTCACTTTTGTACCCCAAAACC<br>AGACTATCGAGTCCCCAGATAATGCTCTGCAATTTCGCCTCTA<br>TGGCAAGGACTACAATGTCTACACACATAGCTTCTTGTGCTAT<br>GGGAAGGATCAGGCACTCTGGCAGAAACTGGCCAAGGACATT<br>CAGGTTGCAAGTAATGAATTCTCAGGGACCCATGCTTTCATC<br>CTGGATATAAGAAGGTAGTGAACGTAAGTGACCTTTACAAGA<br>CCCCCTGCACCAAGAGATTTGAGATGACTCTTCCATTCCAGCA<br>GTTTGAAATCCAGGGTATTGGAAACTATCAACAATGCCATCAA<br>AGCATCCTGGAGCTCTTCAACACCAGTTACTGCCCTTACTCCC<br>AGTGTGCCTTCAATGGGATTTTCTTGCCACCACTCCAGGGGGA<br>TTTTGGGGCATTTTCAGCTTTTTACTTTGTGATGAAGTTTTTAA<br>ACTTGACATCAGAGAAAGTCTCTCAGGAAAAGGTGACTGAGA<br>TGATGAAAAAGTTCTGTGCTCAGCCTTGGGAGGAGATAAAAA<br>CATCTTACGCTGGAGTAAAGGAGAAGTACCTGAGTGAATACT<br>GCTTTTCTGGTACCTACATTCTCTCCCTCCTTCTGCAAGGCTAT<br>CATTTCACAGCTGATTCCTGGGAGCACATCCATTTCATTGGCA<br>AGATCCAGGGCAGCGACGCCGGCTGGACTTTGGGCTACATGC<br>TGAACCTGACCAACATGATCCCAGCTGAGCAACCATTGTCCAC<br>ACCTCTCTCCCACTCCACCTATGTCTTCCTCATGGTTCTATTCT<br>CCCTGGTCCTTTTCACAGTGGCCATCATAGGCTTGCTTATCTTT<br>CACAAGCCTTCATATTTCTGGAAAGATATGGTA |
| MouseENTPD1:<br>NP_033978 |  |
| SEQ ID NO: 351 | MEDIKDSKVKRFCSKNILIILGFTSILAVIALIAVGLTQNKPLPENV<br>KYGIVLDAGSSHTNLYIYKWPAEKENDTGVVQQLEECQVKGPGI<br>SKYAQKTDEIGAYLAECMELSTELIPTSKHHQTPVYLGATAGMR<br>LLRMESEQSADEVLAAVSTSLKSYPFDFQGAKIITGQEEGAYGWI<br>TINYLLGRFTQEQSWLSLISDSQKQETFGALDLGGASTQITFVPQN<br>STIESPENSLQFRLYGEDYTVYTHSFLCYGKDQALWQKLAKDIQ<br>VSSGGVLKDPCFNPGYEKVVNVSELYGTPCTKRFEKKLPFDQFRI<br>QGTGDYEQCHQSILELFNNSHCPYSQCAFNGVFLPPLHGSFGAFS<br>AFYFVMDFFKKVAKNSVISQEKMTEITKNFCSKSWEETKTSYPSV<br>KEKYLSEYCFSGAYILSLLQGYNFTDSSWEQIHFMGKIKDSNAG<br>WTLGYMLNLTNMIPAEQPLSPPLPHSTYIGLMVLFSLLLVAVAIT<br>GLFIYSKPSYFWKEAV |
| SEQ ID NO: 352 | ATGGAAGATATAAAGGATTCTAAGGTGAAGAGATTTTGCTCC<br>AAAAATATTCTGATCATCCTTGGTTTCACCTCTATCTTGGCTGT<br>GATAGCTTTGATTGCTGTGGGACTGACCCAGAACAAACCTTTG<br>CCAGAAAATGTTAAGTATGGGATTGTGTTGGATGCGGGGTCAT<br>CTCACACCAACCTGTACATCTACAAGTGGCCGGCCGAGAAGG<br>AGAATGACACAGGGGTGGTGCAGCAGTTAGAGGAATGCCAAG<br>TGAAAGGTCCTGGAATCTCAAAATATGCTCAGAAAACAGATG<br>AAATCGGTGCGTACCTGGCCGAATGCATGGAACTGTCCACCG<br>AACTGATACCAACATCCAAGCATCACCAGACTCCTGTCTACCT<br>GGGAGCCACAGCAGGCATGCGCTTGCTTAGAATGGAAAGCGA<br>ACAATCGGCAGACGAGGTCCTGGCTGCAGTGTCAACAAGCCT<br>TAAGAGCTACCCCTTTGACTTCCAGGGTGCCAAGATCATCACT<br>GGACAAGAGGAAGGTGCCTATGGGTGGATTACTATTAACTAT<br>CTGCTGGGCAGATTCACTCAGGAACAGAGTTGGCTAAGCCTC<br>ATCTCAGACAGTCAGAAACAGGAAACCTTTGGCGCTTTGGATC<br>TCGGCGGAGCCTCCACACAGATCACCTTCGTGCCCCAAAACA<br>GCACTATAGAGTCCCCAGAAAACTCTCTGCAATTCCGTCTCTA<br>TGGCGAGGACTATACTGTGTACACACACAGCTTCCTGTGCTAT<br>GGGAAGGATCAGGCTCTCTGGCAGAAACTGGCCAAGGACATT |

TABLE 24-continued

Sequences of reagents used for generating anti-ENTPD2 antibody

```
CAGGTTTCAAGTGGTGGCGTCCTTAAGGACCCATGCTTTAACC
CAGGATACGAGAAGGTTGTGAATGTAAGTGAGCTCTATGGCA
CTCCCTGCACCAAAAGATTCGAAAAGAAGCTACCATTTGATCA
GTTTCGAATCCAGGGCACTGGAGACTACGAACAGTGCCACCA
GAGCATCCTTGAGCTCTTCAACAACAGCCACTGCCCTTACTCC
CAGTGTGCCTTCAATGGCGTCTTCCTGCCACCTCTCCATGGGA
GTTTTGGGGCGTTTTCTGCTTTCTACTTTGTGATGGATTTTTTT
AAGAAGGTAGCGAAAAACAGTGTCATCTCTCAGGAGAAAATG
ACCGAGATAACAAAAAATTTTTGCTCAAAATCTTGGGAAGAG
ACAAAGACATCTTATCCTTCAGTAAAGGAGAAGTACCTGAGT
GAGTACTGCTTCTCGGGCGCCTACATCCTCTCTCCTGCAAG
GCTATAACTTCACAGACAGCTCCTGGGAACAGATTCATTTTAT
GGGCAAGATCAAAGACAGCAACGCGGGGTGGACTTTGGGCTA
CATGCTGAACTTGACCAACATGATCCCAGCTGAACAGCCGTTG
TCCCCGCCTCTCCCTCACTCCACCTACATCGGCCTCATGGTTCT
CTTCTCCCTGCTCTTGGTTGCTGTGGCCATCACAGGCCTGTTCA
TCTATAGCAAGCCTTCATATTTCTGGAAAGAGGCAGTA
```

Expression and Purification of Recombinant Mouse ENTPD1 and Mouse and Rat ENTPD2 from HEK Cultures Recombinant monomeric mouse or rat ENTPD2, as well as mouse ENTPD1 were generated as follows: FreeStyle™ 293-F cells (Thermo Fisher Scientific) were cultivated in Gibco™ FreeStyle™ 293 Expression medium and transiently transfected with a plasmid containing a CMV promoter, a mouse IgK signal peptide, residues 29-462 of mouse or rat ENTPD2 (the extracellular domain) or residues 38-478 of mouse ENTPD1, and a polyhistidine ($His_6$) tag (SEQ ID NO: 1010). Four days post-transfection, cells from a 1 L culture were pelleted at 2600×g for 10 minutes and supernatant was clarified by filtration through a 0.22 µm filter. The supernatant was supplemented with 20 mM Tris-HCl pH 8.0 and 20 mM Imidazole and loaded onto a column pre-packed with 6 mL Ni-NTA agarose (Qiagen). The column was washed with 10 column volumes of Wash Buffer [20 mM Tris (pH 8.0), 150 mM NaCl, 20 mM Imidazole], and eluted with 5 column volumes of Elution Buffer [20 mM Tris (pH 8.0), 150 mM NaCl, 250 mM Imidazole]. Protein was buffer exchanged into TBS pH 7.4 using a PD-10 desalting column (GE Healthcare) and frozen for storage.

Expression and Purification of Human ENTPD1 and Human and Cyno ENTPD2 from Insect Cells The Bac-to-Bac® Baculovirus expression system (Thermo Fisher Scientific) was used to express recombinant human ENTPD1 and human and cyno ENTPD2 proteins. Residues 38-478 of human ENTPD1 or residues 29-462 of human or cyno ENTPD2 were cloned into expression vector pFastBac™1 (Thermo Fisher Scientific) with a GP67 signal peptide and a C-terminal Avi-$His_6$ tag (SEQ ID NO: 1010). The cloned vectors were transformed into DH10Bac™ *Escherichia coli* (Thermo Fisher Scientific) competent cells to make recombinant bacmids. The recombinant bacmids were then extracted using the PureLink® HiPure Plasmid Miniprep kit (Thermo Fisher Scientific) and transfected into Sf9 (*Spodoptera frugiperda*) cells using FuGene® HD (Promega) to generate recombinant baculovirus (BV). After one round of amplification, the resulting BV was used to infect High Five™ (*Trichoplusia ni*) cells (Thermo Fisher Scientific) in a 1 L suspension culture at a density of 2×10$^6$ cells/ml and at a multiplicity of infection (MOI) of 10. At 72 h post-infection, cells were pelleted by centrifugation at 2600×g for 10 min and the media containing the secreted, glycosylated, recombinant protein was collected. The supernatant was then supplemented with 50 mM Tris pH 8.0, 1 mM $NiCl_2$, 5 mM $CaCl_2$ and then centrifuged at 2600×g for 30 min. The supernatant was subjected to filtration through a 0.22 µm filter and loaded onto a column packed with 6 mL Ni-NTA agarose (Qiagen). The column was washed with 10 column volumes of Wash Buffer described above, and eluted with Elution Buffer (also described above). Protein was buffer exchanged into TBS (20 mM Tris pH 7.4, 150 mM NaCl) using a PD-10 column (GE Healthcare) and frozen for storage.

Generation of Cell Lines Stably Expressing ENTPD1 or ENTPD2

Stable ENTPD1- or ENTPD2-expressing cell lines were generated using retroviral transduction. To generate retrovirus, 293T cells were co-transfected with a retroviral expression vector expressing ENTPD1 or ENTPD2 and a pCL-Eco or pCL-10A1 packaging vector (Novus Biologicals, cat #NBP2-29540 or NBP2-2952) using FuGene® 6 transfection reagent (Promega, cat #E2692) according to the manufacturer's recommendation. Cells were maintained in a humidified incubator at 37° C. and 5% $CO_2$, and virus-containing cell supernatants were collected 48 hours post-transfection. NIH/3T3 and 300.19 cells (ATCC®) were grown to near confluence in 6-well plate. Growth media was removed from the cells and viral supernatant was added in the presence of 8 ug Polybrene/ml (EMD Millipore, cat #TR-1003-G). Following incubation for 3-6 hours at 37° C., fresh media was added. Cells were then cultured under appropriate selection conditions to produce stable ENTPD1 or ENTPD2-expressing cell lines.

Generation, Expression and Purification of Virus-Like Particles (VLPs)

300.19 cells were maintained in DMEM with 10% FBS. To make VLPs, cells were exchanged into DMEM with 4% FBS, then co-transfected with a human ENTPD2 expression plasmid and a retroviral Gag expression plasmid at a µg ratio of 3:2. Forty-eight hours post-transfection, cell supernatant was collected and clarified by centrifugation at 2500×g for 5 min in a benchtop centrifuge and kept on ice. VLPs were purified by ultracentrifugation at 100,000×g through a 20% sucrose cushion in Ultra-Clear™ 38.5 ml centrifugation tubes (Beckman Coulter®, catalog #344058) in a Beckman Coulter® SW 32 Ti rotor in a Sorvall™ RC 6 Plus ultracentrifuge. Resulting pellets were resuspended in 300 µl of cold sterile PBS and quantitated using a Pierce BCA Assay (Thermo Fisher Scientific catalog #23225).

Hybridoma Generation

Bcl-2 transgenic mice [C57BL/6-Tgn (bcl-2) 22 WEHI strain] were immunized with antigen using a procedure that calls for Repetitive Immunization at Multiple Sites (RIMMS) (K. E. Kilpatrick et al. Hybridoma 1997). Briefly, mice were injected with 22.5 μg of His6-tagged human ENTPD2 29-462 ECD protein ("His6" disclosed as SEQ ID NO: 1010) at 8 specific sites proximal to peripheral lymph nodes (PLNs). This procedure was repeated 8 times over a 20 day period. On Day 18, a test bleed was collected and the serum antibody titer was analyzed by FACS and ELISA. In some instances, BALB/c mice were immunized with 50 μg of His6-tagged human ENTPD2 29-462 ECD ("His6" disclosed as SEQ ID NO: 1010) protein in Freund's Complete, Sigma Adjuvant System®, or Freund's Incomplete adjuvant, 50 μg of human ENTPD2-expressing VLPs in PBS, or 5×10e6 300.19 cells stably over-expressing human ENTPD2 (SEQ ID NO: 291) in PBS. Animals were injected subcutaneously or intraperitoneally twice two weeks apart, followed by an intravenous boost approximately two weeks later with either 50 μg of human ENTPD2-expressing VLPs or His6-tagged human ENTPD2 29-462 ECD protein in PBS ("His6" disclosed as SEQ ID NO: 1010). Ten days after the second immunization, a test bleed was collected and serum antibody titer was analyzed by FACS and ELISA. Spleens and pooled peripheral lymph nodes (PLNs) were removed from high-titer mice. To harvest lymphocytes, spleens and PLNs were washed once in PBS, and then dissociated by passage through a 70 micron screen (Falcon #352350). The resulting lymphocytes were washed 2 additional times prior to fusion in Cytofusion® medium (BTXpress Cytofusion® Electroporation Medium cat #47001).

For the fusion, F0 myeloma cells were mixed with lymphocytes at a 1:4 ratio. The cell mixture was centrifuged, suspended in Cytofusion® medium and subsequently added to an electrofusion chamber (Harvard Apparatus Coaxial chamber 9ML Part #470020). Electrofusion was carried out per manufacturer's instructions using the CEEF-50B Hybrimune/Hybridoma system (Cyto Pulse Sciences, Inc). Fused cells were allowed to recover for 5 minutes in the chamber, diluted 1:10 in media without hypoxanthine-aminopterin-thymidine (HAT) [DMEM+20% FBS, 1% Penicillin-Streptomycin-Glutamine (PSG), 1× Non-Essential Amino Acids (NEAA), 0.5× Hybridoma Fusion and Cloning Supplement (Roche; HFCS))] and placed at 37° C. and 5% $CO_2$ for one hour. Next, 4×HAT medium (DMEM+20% FBS, 1% PSG, 1×NEAA, 4×HAT, 0.5×HFCS) was added to bring the concentration of HAT to 1×, and the density was adjusted to 66,000 cells/ml. The cells were plated in 384-well plates at 60 ul/well.

FACS Screening

Ten days after fusion, hybridoma plates were screened for the presence of ENTPD2-specific antibodies using flow cytometry to confirm specific binding of candidate antibodies to cell surface-expressed human ENTPD2 using three cell lines: parental NIH/3T3 cells, NIH/3T3 cells stably overexpressing human ENTPD2, and RKO cells (ATCC®), which expresses endogenous human ENTPD2. Cells were rinsed thoroughly with PBS, treated with Accutase (Millipore #SCR005) to lift them from the growth plates, and resuspended in cold PBS. Cells were biotinylated and labeled with a fluorescent dye according to manufacturer's instructions (FluoReporter™ Cell-Surface Biotinylation Kit, Thermo Fisher Scientific Cat #F-20650; PE-Cy7 Steptavidin, ThermoFisher Scientific Cat #SA1012). Cells were resuspended at approximately $1×10^6$ cells/ml in FACS buffer (PBS with 2% FBS+0.1% $NaN_3$). In a 384-well plate, 20 μL of hybridoma supernatant was pre-seeded and 20 μL of cell suspension was added. Cells were incubated for 1 hour at 4° C., washed twice with cold FACS buffer, and resuspended in 20 μL of FACS buffer containing secondary antibody at a 1:400 dilution (Allophycocyanin-conjugated F(ab')2 goat anti-mouse IgG, Fcγ specific; Jackson Immunoresearch, cat #115-136-071). After additional incubation for 45 min at 4° C., cells were washed twice with FACS buffer and resuspended in 20 μL of FACS buffer with 2 μg/ml propidium iodide (Sigma Aldrich Cat #P4864). Geometric mean fluorescence intensity was calculated on live single cells using FlowJo™ software.

Hits from this primary cell-based flow cytometry screen were confirmed in a secondary flow cytometry screen. Hybridomas expressing antibodies that bound to both NIH/3T3-hENTPD2 and RKO cells were expanded into 45 mL protein production cultures in hybridoma serum-free medium with HT Media Supplement (50×) Hybri-Max™ (Sigma, cat #H0137) in CellStar® Autoflasks™ (Greiner Bio-One). Cultures were maintained in a shaking incubator at 37° C. and 5% CO2 for approximately 8 days and then cells were pelleted and supernatants were taken through purification over Protein G resin. Proteins were subsequently buffer exchanged into PBS using NAP-10™ columns (GE Healthcare).

Recombinant Antibody Production

Hybridoma-derived mAbs were screened in a cell-based assay for inhibition of ATP hydrolysis by ENTPD2. Two lead inhibitory mAbs were identified in this assay: mAb17 and mAb16.

Chimeric antibodies comprised of murine variable regions and human constant regions were prepared. Variable region (VH and VL) DNA sequences of hybridomas were obtained for cloning and antibody optimization (humanization, removal of potential post-translational modifications, etc.). Variable region DNA from murine monoclonal antibodies was amplified by 5' RACE from RNA obtained from each selected hybridoma cell line using standard methods. Polypeptide sequences for each of the murine variable heavy/light chains are shown in Table 1 for mAb17 and mAb16, respectively. Corresponding variable heavy/light nucleotide sequences for each of the hybridomas are shown in SEQ ID NO: 234/SEQ ID NO: 238, and SEQ ID NO: 226/SEQ ID NO: 230. For preparation of chimeric antibodies, DNA sequences coding for the hybridoma VL and VH amplified by 5' RACE-PCR were cloned into expression vectors containing the respective human wild type heavy chain and human light chain constant region sequences (IgG1, kappa). These vectors were miniprepped using the QIAprep Spin Miniprep Kit (QIAGEN, cat #27106) and nucleofected into a proprietary CHO cell line using an Amaxa™ 4D-Nucleofector™ (Lonza). Transfected cells were placed in selective media for stable pool generation, and resulting pools were subjected to a 14-day fed-batch protein production process. Protein-containing cell supernatants were clarified by centrifugation at 3000×g for 15 minutes and filtration through a 0.22 μm filter. Proteins were purified using MabSelect SuRe™ resin (GE Healthcare) on an ÄKTA™ Pure or an ÄKTA™ Purifier and eluted using Pierce™ IgG Elution Buffer (Thermo Fisher Scientific #21004), then buffer exchanged into PBS either by dialysis or using a HiPrep Desalting column (GE Healthcare). In cases where the resulting protein was <95% dimer by analytical size exclusion chromatography (AnSEC) using a Superdex® 200 Increase, the protein was subjected to preparative SEC using a HiLoad® Superdex® 200 column (GE Healthcare) using PBS as the mobile phase.

Humanization

Variable region constructs were also designed for humanization and optimization of sequences (e.g., removal of potential post-translational modification sites) using an internal software program. One or more human frameworks were chosen for each mouse VH and VL with back mutations in the Vernier Zones (Foote and Winter 1992, Journal of Molecular Biology; 224 (2):487-499) to maintain affinity and desired functional activity. Both mAb17 and mAb16 were also humanized using three-dimensional crystal structure-based design. Briefly, the crystal structure was loaded into Molecular Operating Environment (MOE™) (Chemical Computing Group ULC) and prepared using the standard structure preparation methodology with the Amber10EHT force field. The Fab was then compared structurally with an in-house library of humanized Fabs using a custom script called "cdr_grafter SVL". The script structurally compares the input murine Fab structure with human Fab structures in an internal database and lists detailed parameters regarding structural similarities between the murine (donor) and human (acceptor) Fabs. These parameters include framework and stem region RMSDs and CDR length comparisons. Based on these parameters, four candidate acceptor Fabs were selected for grafting donor CDRs from mAb17 and three candidate acceptor Fabs were selected for grafting donor CDRs from mAb16. Humanization of mAb17 led to the generation of mAb1, mAb2, mAb3, and mAb7. Humanization and optimization of mAb16 led to the generation of mAb4, mAb5, and mAb6.

DNA sequences coding for the designed humanized VL and VH domains from both humanization strategies were ordered from GeneArt (Life Technologies Inc. Regensburg, Germany) with codon optimization for *Cricetulus griseus*. These variable regions were subcloned into expression vectors containing the respective human wild-type heavy chain and human light chain constant region sequences (IgG1, kappa) using standard methods.

Recombinant antibodies were produced by co-transfection of vectors encoding heavy and light chains into FreeStyle™ 293-F cells (Thermo Fisher Scientific). Transfected cells were maintained in Gibco® FreeStyle™ 293 Expression Medium (Thermo Fisher Scientific #12338018) in CellStar® Autoflasks™ (Greiner Bio-One) housed in a shaking incubator at 37° C. and 5% $CO_2$ for approximately 5 days and then cells were pelleted and protein-containing supernatants were taken through purification over MabSelect SuRe™ resin (GE Healthcare). Proteins were subsequently buffer exchanged into PBS using NAP-10™ columns (GE Healthcare).

Example 3. Generation of Human Anti-Human ENTPD2 Antibodies and Fab Fragments Thereof Using Phase Display Fabs that specifically bind to human ENTPD2 (SEQ ID NO: 291) were generated using the MorphoSys HuCAL PLATINUM® phage display technology. The phagemid library is based on the HuCAL® concept (Knappik et al., 2000, J Mol Biol 296, 57-86) and employs the CysDisplay™ technology for displaying the Fab on the phage surface (Lohning, WO 2001/05950).

Four types of panning were performed: solid-phase panning against directly coated recombinant human ENTPD2 (hENTPD2), solution panning against ENTPD2, whole-cell panning, and affinity maturation panning.

Bead-Based Panning

Prior to a bead-based panning, the antigen was immobilized on magnetic carboxylic acid-coated beads (Dynabeads™ M-270 Carboxylic Acid, Thermo Fisher Scientific Cat #14306D). Per phage pool, $1 \times 10^7$ antigen-coated beads were blocked 1× ChemiBlocker (EMD Millipore). In parallel, an appropriate amount of phage-antibodies was blocked with 50% human serum/0.33×chemiblocker/0.05% Tween20. For prevention of selecting bead-binding phage, blocked phage particles were pre-incubated using beads with immobilized irrelevant protein. Blocked antigen-coated beads were added to the pre-adsorbed and blocked phage particles and the phage-antibodies were allowed to bind to the antigen coated beads. Phage particles bound to the antigen-coated beads were collected by magnetic separation. Several washing steps removed non-specifically bound phage. Finally, specifically bound phage were eluted from antigen-coated beads. The eluate was transferred into 14 ml of *E. coli* TG1 culture and incubated for phage infection.

Upon centrifugation, the infected bacteria were pelleted and resuspended in 2×YT medium, plated on LB/chloramphenicol agar plates and incubated overnight. Colonies were scraped off the plates and were used for phage rescue, polyclonal amplification of selected clones, and phage production. With purified phage the next panning round was started. The second and third round of solid phase panning was performed using the same protocol as the first round except that less antigen and more stringent washing conditions were used.

Solution Panning

An appropriate amount of Streptavidin beads (Dynabeads™ M-280 Streptavidin, Thermo Fisher Scientific Cat #11206D) were blocked. In parallel, an appropriate amount of phage-antibodies were blocked. For removal of Streptavidin- or bead-binding phage, pre-adsorption of blocked phage particles was performed using blocked Streptavidin beads coated with biotinylated irrelevant protein. Then, biotinylated ENTPD2 was added to the pre-adsorbed and blocked phage particles and the phage-antibodies were allowed to bind to the antigen in solution. The phage-antigen complexes were captured using blocked Streptavidin beads and phage particles bound to the Streptavidin beads were collected with a magnetic separator. Unspecifically-bound phage were washed off by several washing steps. Specifically-bound phage were eluted from Streptavidin beads. The eluate was transferred into 14 ml of *E. coli* TG1 culture and incubated for phage infection. Subsequent phage infection and phage production were performed according to the Bead-based Panning protocol and the next panning round was started. The second and third round of bead-based solution panning were performed using the same protocol the first panning round except that washing conditions with increased stringency were applied.

Whole Cell Panning

For each panning, an appropriate amount of phage-antibodies was blocked. In parallel, an appropriate amount of target cells expressing ENTPD2 and an appropriate amount of adsorption cells without expression of antigen ENTPD2 were blocked for each phage pool. The blocked target cells were spun down, re-suspended in the pre-blocked phage particles and the phage-antibodies were allowed to bind to the antigen presented on the cell. The phage-cell complexes were washed several times. Specifically-bound phage were eluted from target cells. After centrifugation, the supernatant (eluate) was applied to antigen-negative adsorption cells for removal of phage binding to cell surface molecules other than the target antigen (post-adsorption). The final supernatant was transferred to an *E. coli* TG1 culture for phage infection. The second and third round of the whole-cell panning were performed using the same protocol as the first panning round.

Affinity Maturation Panning

Generation of HuCAL PLATINUM® Maturation Libraries

Four Fab candidates were selected for affinity maturation. To increase affinity and biological activity of selected antibodies, CDR-L3 and CDR-H2 regions were optimized by cassette mutagenesis using trinucleotide-directed mutagenesis, while the framework regions were kept constant (Virnekäs et al. 1994, *Nucleic Acids Research* 22 (25), pp. 5600-5607). For CDR-L3 optimization, a ~400 bp DNA fragment encoding for the CDR-L3, framework 4 as well as the constant region of the light chain was removed from the sequence encoding the parental antibodies by restriction digest and replaced by a repertoire of DNA fragments encoding for diversified CDR-L3 regions together with framework 4 and the constant domain. In a second library set the CDR-H2-encoding sequence was diversified, while the connecting framework regions were kept constant. In order to reduce the background of the parental undiversified sequence a ~150 bp DNA fragment containing the parental CDR-H2 and the framework 3 sequences was replaced by a ~590 bp dummy sequence via restriction digest and ligation, before the diversified CDR-H2 cassette (incl. framework 3) was inserted also via restriction digest and ligation. Electroporation of ligation mixtures were in MC1061F' cells yielded approximately $10^8$ to $10^9$ in $>5 \times 10^6$ independent colonies. Amplification of the library was performed as described previously (Rauchenberger et al. 2003, *J biol chem* 278 (40), pp. 38194-38205). For quality control, approx. 10-20 single clones per library were randomly picked and sequenced.

For the selection of candidates that are affinity improved, phage derived from maturation libraries were subjected to two to three rounds of maturation panning. Panning stringency was increased by lowering the antigen concentration in each panning round (Low et al. 1996, *J. Mol. Biol.* 260, pp. 359-368). In addition to antigen reduction, off-rate selection was performed (Hawkins et al. 1992, *J. Mol. Biol.* 226 (3), pp. 889-896). These strategies were combined with prolonged washing steps.

Expression

Subcloning from Display Vector into Fab-Expression Vector for *E. coli*

To facilitate rapid expression of soluble Fab, the Fab-encoding inserts of the selected HuCAL PLATINUM® phage were subcloned from pMORPH® 30 display vector into pMORPH® x11 expression vector pMORPH® x11_FH. After transformation of *E. coli* TG1 F-single clone expression and preparation of periplasmic extracts containing HuCAL®-Fab fragments were performed as described previously (Rauchenberger et al., 2003, J Biol Chem 278: 38194-38205).

Micro Scale Production of His-Tagged Fab Fragments

Expression of Fab fragments encoded by bacterial expression vector in *E. coli* TG1 F-cells was carried out in 50 mL Falcon tubes using 25 mL of 2×YT medium supplemented with 0.1% glucose, 34 µg/mL chloramphenicol and 1 mM IPTG (isopropyl-β-D-thiogalactopyranoside). Cultures were shaken at 30° C. for 18 h. Cells were harvested and disrupted using a combination of lysozyme and Bug Buster® Protein Extraction Reagent (Merck, Germany). His6-tagged Fab fragments ("His6" disclosed as SEQ ID NO: 1010) were isolated via IMAC (GE Healthcare, Germany) and eluted using imidazole. Buffer exchange to 1× Dulbecco's PBS (pH 7.2) was performed using 'PD MultiTrap™ G-25' plates (GE Healthcare, Germany). Protein concentrations were determined by UV-spectrophotometry. The purity of representatively selected samples was analyzed in denaturing, non-reducing 15% SDS-PAGE.

Subcloning into IgG & FabCys Expression Vector and Expression in HKB11 Cells

For full-length IgG expression in HKB11 cells, selected candidates or candidate pools were cloned into the pMORPH® 4_IgG1f vector. Subcloning was performed as a two-step method for a convenient and efficient conversion of a large number of sequence-unique Fab clones into the IgG format.

Eukaryotic HKB11 cells were transfected with mammalian expression vector DNA encoding both heavy and light chains of IgG. Cell culture supernatants were harvested on day 3 or 6 post-transfection and subjected to standard Protein A affinity chromatography (MabSelect™ SuRe™, GE Healthcare). Unless stated otherwise, buffer exchange was performed to 1× Dulbcecco's PBS (pH 7.2, Invitrogen) and samples were sterile filtered (0.2 µm pore size).

Protein concentrations were determined by UV-spectrophotometry and purities of IgG were analyzed under denaturing, reducing and non-reducing conditions using CE-SDS (LabChip GXII, Perkin Elmer, USA). HP-SEC was performed to analyze IgG preparations in native state.

Summary of Antibodies

Table 1 sets forth sequence information for anti-human ENTPD2 antibodies derived from murine hybridomas and phage display.

Example 4. Biochemical Characterization of Anti-Human ENTPD2 Antibodies

Anti-human ENTPD2 antibodies were evaluated in the following assays.

FACS screening: Specific binding of candidate antibodies to endogenously expressed ENTPD2 was assessed by flow cytometry. Cells were rinsed thoroughly with 1×PBS and treated with Accutase (Millipore #SCR005) to lift from growth plates and resuspended at approximately $1 \times 10^5$ cells/90 µL in 1×FACS buffer (2% FBS+0.1% NaN3 in PBS). In a 96-well U-bottom plate, 10 µL of 10× antibody solution in FACS buffer was pre-seeded and 90 µL of cell suspension was added. Cell were incubated for 30 minutes at 4° C., washed 1× with cold PBS and resuspended in 100 µL of 1:500 secondary antibody 1×FACS buffer (Allophycocyanin conjugated F(ab')2 goat anti-human IgG, Fcγ specific; Jackson Immunoresearch, Cat #109-136-098). After additional incubation for 15 min at 4° C., cells were washed twice with PBS and resuspended in 100 µL of 1×FACS buffer with 4 µg/mL propidium iodide (Life Technologies, Cat #P3566). Geometric mean fluorescence intensity was calculated on live single cells using FlowJo software.

ELISA screening on directly coated antigen: Maxisorp™ 384-well plates (Thermo Nunc) were coated with 2 µg/ml of recombinant ENTPD2 diluted in PBS. After blocking with 2% BSA (bovine serum albumin) in PBS for 1 hr at room temperature, washing plates 3× with TBST (0.05% Tween 20 in TBS, Sigma Cat #T9039), primary antibodies in TBST and 2% BSA were added in a serial dilution and incubated for 1 hr at room temperature. Plates were washed again and bound antibodies were detected by incubation with anti-hFc gamma conjugated to horseradish peroxidase (HRP; Jackson ImmunoResearch, Cat #115-035-098, diluted 1:5000 in 1×TBST+2% BSA) for 1 hr at room temperature followed by washing with TBST and afterwards addition of SureBlue Peroxidase substrate (KPL, #52-00-03) substrate. After 15 min, absorbance at 650 nM was recorded and analyzed in GraphPad Prism6.

Biacore™ Screening: Affinity was measured by determining the kinetic rate constants using surface plasmon resonance (SPR) on a Biacore™ T200 or T100 with the T200 sensitivity upgrade instrument (Biacore™, GE Healthcare). Antibodies were captured on CM5 sensor chips (Biacore™, GE Healthcare) prepared with a mouse anti-human IgG Fc antibody (ThermoFisher catalogue #05-4200) amine coupled to the surface. Binding of human and cynomologus (cyno) ENTPD2 ECDs at 25° C. were detected at concentrations ranging from 0.78 nM to 500 nM depending on the affinity of the antibody. ENTPD2 analytes were allowed to associate for 180 s and dissociate for up to 1800 s depending on the off-rate of the antibody at a flow rate of 30 μL/min. The running buffer was PBS pH 7.2 (prepared from a Corning 10× stock, cat #46-013-CM)+0.05% Tween 20. Regeneration was accomplished with 30 s injections of 3 or 4 M MgCl2 to remove all the captured antibody and remaining complex from the surface, after which fresh antibody was captured. The raw data were analyzed using Biacore™ T200 Evaluation Software version 1.0 and fit to a 1:1 binding model, with all parameters set to fit globally except for RI, which was set to fit locally.

Antibody specificity for mAb1-mAb10 was confirmed. All clones showed significant nM to sub-nM binding to human ENTPD2. Antibodies mAb8, mAb9, and mAb10 show weak affinity to mouse ENTPD2. None of the selected antibodies bind to rat ENTPD2. See Table 21 and Table 22.

TABLE 21

Dissociation constant ($K_D$) for select anti-human ENTPD2 antibodies

| | Human ENTPD2 BIACore™ | | | Cyno ENTPD2 BIACore™ | | | Mouse ENTPD2 BIACore™ |
|---|---|---|---|---|---|---|---|
| | $K_D$ (nM) | $k_a$ (1/Ms) | $k_d$ (1/s) | $K_D$ (nM) | $k_a$ (1/Ms) | $k_d$ (1/s) | $K_D$ (nM) |
| MAB1 | 1.7 | 1.1E+05 | 1.9E−04 | 3.4 | 3.6E+05 | 1.2E−03 | No binding |
| MAB2 | 1.7 | 1.1E+05 | 1.8E−04 | 2.8 | 4.3E+05 | 1.2E−03 | No binding |
| MAB3 | 1.3 | 1.3E+05 | 1.6E−04 | 2.2 | 4.5E+05 | 9.8E−04 | No binding |
| MAB4 | 0.7 | 3.0E+05 | 2.2E−04 | 42.1 | 1.4E+05 | 5.7E−03 | No binding |
| MAB5 | 0.6 | 2.7E+05 | 1.6E−04 | 10.7 | 2.9E+05 | 3.0E−03 | No binding |
| MAB6 | 0.7 | 3.5E+05 | 2.6E−04 | 35.6 | 2.9E+05 | 1.0E−02 | No binding |
| MAB7 | 0.9 | 2.1E+05 | 1.9E−04 | 1.1 | 1.2E+06 | 1.2E−03 | No binding |
| MAB8 | 3.3 | 2.9E+05 | 9.4E−04 | 81.1 | 3.0E+05 | 2.4E−02 | Weak binding |
| MAB9 | 0.9 | 3.8E+05 | 3.0E−04 | 20.9 | 9.9E+05 | 2.1E−02 | 750 |
| MAB10 | 0.8 | 3.4E+05 | 2.4E−04 | 15.2 | 1.2E+06 | 1.8E−02 | Weak binding |

TABLE 22

Binding of select anti-human ENTPD2 antibodies to ENTPD2 Expressing Cells

| | Apparent FACS Affinity; EC50 (nM) | | |
|---|---|---|---|
| Antibody | NIH3T3 humanENTPD2 | NIH3T3 cynoENTPD2 | RKO |
| ANTI-HUMAN ENTPD2 MAB1 | 1.5 | 3.3 | 0.9 |
| ANTI-HUMAN ENTPD2 MAB2 | 2.1 | 4.2 | 1.3 |
| ANTI-HUMAN ENTPD2 MAB3 | 2.8 | 5.4 | 2.1 |
| ANTI-HUMAN ENTPD2 MAB4 | 0.9 | 6.1 | 0.5 |
| ANTI-HUMAN ENTPD2 MAB5 | 0.9 | 5.2 | 0.4 |
| ANTI-HUMAN ENTPD2 MAB6 | 0.9 | 7.0 | 0.4 |
| ANTI-HUMAN ENTPD2 MAB7 | 0.5 | 0.8 | 0.4 |
| ANTI-HUMAN ENTPD2 MAB8 | 0.6 | 2.1 | 0.3 |
| ANTI-HUMAN ENTPD2 MAB9 | 0.6 | 1.3 | 0.5 |
| ANTI-HUMAN ENTPD2 MAB10 | 0.8 | 1.7 | 0.6 |

Cross reactivity Human ENTPD1 (NP_001767) expressing NIH/3T3 cells were generated using a retroviral transduction approach. 72 hrs post transduction, engineered cells were stained with the anti-Human CD39/ENTPD1 APC-conjugated Antibody (R&D systems, Minneapolis, MN) and live cells that expressed human ENTPD1 were separated from the rest of the population via fluorescence activated cell sorting. Stable expression of ENTPD1 was periodically re-confirmed by FACS with the above described anti-Human CD39/ENTPD1 APC-conjugated Antibody (1:100).

H520 cells were identified as a cancer cell line with ENTPD3 (Ct 25) and ENTPD8 (Ct 26) expression by Taqman and were used for selectivity screening.

No significant binding to any of the control cell lines was observed with any of the Anti-human ENTPD2 Abs tested (Table 25).

TABLE 25

Cross Reactivity of Anti-human ENTPD2 mAbs.

| | Apparent FACS binding at 50 nM | | |
|---|---|---|---|
| Antibody | NIH/3T3 cells | NIH/3T3 - ENTPD1 | H520 Cells |
| ANTI-HUMAN ENTPD2 MAB1 | No binding | No binding | No binding |
| ANTI-HUMAN ENTPD2 MAB2 | No binding | No binding | No binding |
| ANTI-HUMAN ENTPD2 MAB3 | No binding | No binding | No binding |

TABLE 25-continued

Cross Reactivity of Anti-human ENTPD2 mAbs.

| Antibody | Apparent FACS binding at 50 nM | | |
|---|---|---|---|
| | NIH/3T3 cells | NIH/3T3 - ENTPD1 | H520 Cells |
| ANTI-HUMAN ENTPD2 MAB4 | No binding | No binding | No binding |
| ANTI-HUMAN ENTPD2 MAB5 | No binding | No binding | No binding |
| ANTI-HUMAN ENTPD2 MAB6 | No binding | No binding | No binding |
| ANTI-HUMAN ENTPD2 MAB7 | No binding | No binding | No binding |
| ANTI-HUMAN ENTPD2 MAB8 | No binding | >100 nM | No binding |
| ANTI-HUMAN ENTPD2 MAB9 | No binding | No binding | No binding |
| ANTI-HUMAN ENTPD2 MAB10 | No binding | No binding | No binding |

Epitope Binning Using Octet Red96 System

Epitope binning of anti-human ENTPD2 antibodies was performed using the Octet Red96 system (ForteBio, USA) that measures biolayer interferometry (BLI). Human ENTPD2-Avi-His6 protein ("His6" disclosed as SEQ ID NO: 1010) was biotinylated via an AviTag™ utilizing BirA biotin ligase according to manufacturer's recommendations (Avidity, LLC, USA cat #BirA500). The biotinylated immunogen scaffold was loaded at 0.5 μg/mL onto pre-equilibrated streptavidin sensors (ForteBio, USA). The sensors were then transferred to a solution containing 100 nM antibody A in 1× kinetics buffer (ForteBio, USA). Sensors were briefly washed in 1× kinetics buffer and transferred to a second solution containing 100 nM of competitor antibody. Binding kinetics was determined from raw data using the Octet Red96 system analysis software (Version 9.0, ForteBio, USA). Antibodies were tested in all pairwise combinations, as both the first (blocking) antibody bound to hENTPD2 and as the second (competitor) antibody. All of the antibodies demonstrated significant cross-blocking in this assay, indicating that mAb1-10 may have similar epitope.

Example 5. Crystallography and Epitope Mapping of Anti-Human ENTPD2 FAb22

In this Example, anti-human ENTPD2 FAb22 was crystallized in complex with human ENTPD2 (Y350A mutant) ectodomain and the corresponding structure was determined. Analysis of anti-human ENTPD2 FAb22 binding to human ENTPD2 based on the X-ray data provided molecular details of antigen engagement and insights to the Fab paratopes and antigen epitopes revealed.

Materials and Methods

Expression and Purification of Fab Fragments

DNA sequences coding for the identified VH and VL domains were subcloned into mammalian expression vectors containing the respective human wild-type CH1 and human kappa light chain constant region sequences. Recombinant human Fabs were produced by transient co-transfection of vectors into cells using transfection reagent. Following transfection, cells were cultured for 5 to 6 days, and purification of antibodies was carried out. Cells were pelleted by centrifugation (2600×g for 10 minutes), and antibody-containing cell supernatants were clarified by filtration through a 0.22 □m filter. Fabs were purified over Protein G (GE Healthcare Life Sciences) columns and eluted using acidic eluate buffer conditions.

Preparation of Human ENTPD2 and Anti-Human ENTPD2 FAb22 Complex

To prepare the ENTPD2-FAb22 complex, a 1.3-fold molar excess of FAb22 was combined with hENTPD2 Y350A in 20 mM Tris pH 7.5 with 150 mM NaCl to give a final concentration of 5.65 mg/mL. The complex sample was incubated on ice for 2 hours and submitted for crystallization screen set ups.

Crystallization and X-Ray Data Collection

Crystals were grown in 96-well plates (Greiner Bio-One Crystalquick Plus plates) by sitting drop vapor diffusion. In detail, 0.2 μl of protein stock was mixed with 0.2 μl of reservoir solution, and the drop was equilibrated against 50 μl of the same reservoir solution at 20° C. The experiments were set up with a Phoenix robotic system (Art Robbins Instruments), and stored in in-house custom engineered crystal imager and gantry (Novartis GNF internal systems).

For X-ray data collection, a single crystal was directly mounted in a cryo-loop and flash cooled into liquid nitrogen. X-ray data were collected at the Advanced Light Source, BL5.03, with Quantum Q315 CCD detector, using 0.9765 Å X-ray radiation. 180 images of 1.0° oscillation each were recorded at a crystal-to-detector distance of 350 mm and processed with HKL2000 (Z. Otwinowski and W. Minor, "Processing of X-ray Diffraction Data Collected in Oscillation Mode", Methods in Enzymology, Volume 276: Macromolecular Crystallography, part A, p. 307-326, 1997, C. W. Carter, Jr. & R. M. Sweet, Eds., Academic Press (New York).

Structure Determination and Analysis

The structure of the FAb22-ENTPD2 complex was determined by molecular replacement with the program Phaser (McCoy et al., 2007, J Appl Crystallogr 40:658-674), using the refined structures of human ENTPD2 previously determined in house and coordinates for anti-RSV Fab B21m (PDB code 3QRG) as independent search models. The structure was refined using iterative cycles of model building followed by automated crystallographic refinement with the programs Coot 0.8.0 (Crystallographic Object-Oriented Toolkit; Emsley et al., 2010, Acta Crystallogr Sect D: Biol Crystallogr; 66:486-501) and Autobuster 2.11.5 (Bricogne et al., 2011, BUSTER version 2.11.2. Cambridge, United Kingdom: Global Phasing Ltd.).

Visual inspection of the crystal structures was carried out using the programs Coot (Emsley et al., 2010, Acta Crystallogr Sect D: Biol Crystallogr; 66:486-501) and PyMOL (Molecular Graphics System; DeLano Scientific: Palo Alto, CA). The quality of the final refined models was assessed with the programs Coot and PROCHECK v3.3 (Laskowski et al., 1992, J Appl Crystallogr; 26:283-291). Residues of human ENTPD2 that become less accessible to solvent upon binding of the anti-human ENTPD2 FAb22 were identified by the program AREAIMOL of the CCP4 program suite (Collaborative Computational Project, Number 4, 1994). Intermolecular contacts were defined using a cut-off distance of 4.0 Å and were identified with the CCP4 program NCONT.

Results

Crystal Structure of the Anti-hENTPD2 FAb22 in Complex with Human ENTPD2

The anti-hENTPD2 FAb22 complexed with human ENTPD2 Y350A mutant was crystallized in 96-well plates by the method of vapor diffusion in sitting drops, at 20° C. Crystals grew in 0.1M HEPES pH 7.5, 20% polyethylene glycol 3350, 0.2M magnesium chloride. Crystals appeared after approximately 6 weeks and grew to full size within a few days.

The crystal of the FAb22-ENTPD2 complex was in monoclinic space group C2, with one complex per asymmetric unit. A complete diffraction data set was collected for the complex to 2.75 Angstrom resolution.

Structure determination by molecular replacement was performed using the previously determined human ENTPD2 coordinates and Fab coordinates from PDB code 3QRG. Refinement with AutoBuster led to good refinement statistics and overall geometry. Two FAb22 residues, Ala55L and Tyr33H, and four ENTPD2 residues, Gly120, Thr122, Tyr229, and Ala430, were Ramachandran outliers in the structure of the FAb22-ENTPD2 complex. ENTPD2 residues Gly120 and Thr122, in addition to Fab residues Ala55L and Tyr33H are well-defined in the electron-density and are likely genuine geometry outliers. Worthy of note, Tyr33H is a CDR residue involved in ENTPD2 binding as described below. ENTPD2 residues Tyr229 and Ala430 were loosely modeled in the electron density.

Figure 6:
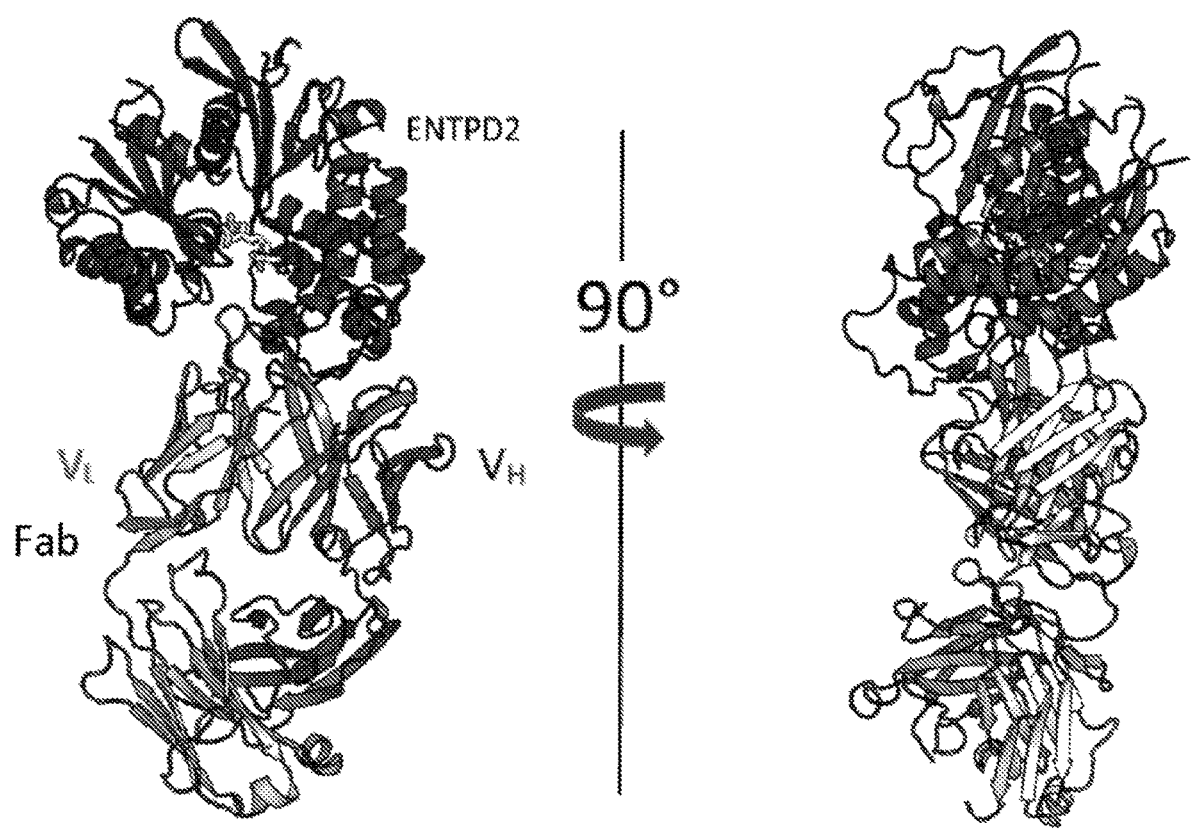
FIG. 6 illustrates an overview of anti-human ENTPD2 FAb22 in complex with human ENTPD2. Two views are shown 90 degrees apart. AMP-PNP is modeled in the ENTPD2 active site based upon superposition with the rat ENTPD2 co-structure PDB 3CJA. The heavy chain of the Fab is shaded darker.

The amino-acid sequences of the anti-human ENTPD2 FAb22 heavy chain and light chain are provided in FIG. 3A, with the CDRs underlined (as defined by Kabat, 1991, Sequences of proteins of immunological interest, NIH Publication No. 91-3242) and residues located at the Fab-antigen interface labeled with *. An overall view of the three dimensional structure of the anti-human ENTPD2 FAb22/ENTPD2 Y350A complex is depicted in FIG. 6.

The amino-acid sequence of recombinant human ENTPD2 used in this example (SEQ ID NO: 291) is provided in FIG. 4A. Soluble extracellular domain of human ENTPD2 spans residues 29-462. An engineered mutation of Y350A was present in the construct and highlighted in gray italics. The construct used here utilized an N-terminal GP67 secretion signal peptide (first 38 residues) and a C-terminal 6× Histidine tag (SEQ ID NO: 1010). Asn64, Asn129, Asn294, Asn378, and Asn443 are predicted N-linked glycosylation sites for which only those where glycosylation was observed in the crystal structure highlighted in gray italics. The secondary structure elements are shown below the amino acid sequence with bars representing α-helices, arrows representing □-strands. Residues for which no secondary structure elements are labeled represent unstructured loop and turn segments.

The human ENTPD2 amino acid sequence bears high sequence homology with rodent species and other mammals and the structure possesses a nearly identical overall fold to that described for the rat ENTPD2 (i.e. PDB code 3CJA, Zebisch, M., Strater, N. (2008) Proc. Natl. Acad. Sci. Usa 105: 6882-6887). Invariant and conserved disulfide pairings are observed for Cys75/Cys99, Cys242/Cys284, Cys265/Cys310, Cys323/Cys328 and Cys377/Cys399. The RMSD (root mean squared deviation) across 388 C-α carbons between the human and rat ENTPD2 structures is approximately 0.365 Å.

The final model for the FAb22/ENTPD2 complex contained residues 37-448 of ENTPD2. The active site for ATP hydrolysis resides between the two subdomains (subdomain 1: Pro36-Ser161 and Lys427-Phe461; subdomain 2: Gly162-Gln426). ENTPD2 residues omitted from final model include residues 29-36 of the N-terminus and 60-65 corresponding to loop residues connecting strands β2 and β3, residues 179-193 corresponding to the membrane interacting loop (MIL), and C-terminal residues beyond Ile448. All heavy and light chain Fab residues were included in the final refined model except the terminal cysteines (Cys228 heavy chain/Cys218 light chain).

The FAb22 binds ENTPD2 antigen primarily through engagement of the predicted membrane distal lobe through interactions involving all 6 CDRs of heavy and light chain variable domains. No FAb22 CDR residues appear to penetrate appreciably into the ENTPD2 active site cleft to affect ATP substrate binding. Heavy chain CDR3 and CDR2 residues sequester residues including and flanking the antiparallel 2 stranded β-sheet comprised of strands β10/β11. Terminal heavy chain CDR3 residues make additional binding contacts to residues of the N-terminal end of helix α14, as well as α8 and α13 helices. Light chain variable domain binding interactions with ENTPD2 largely involve CDR1 and CDR3 residues which bind predominantly the N-terminal end of helix α14. Formation of the FAb22/ENTPD2 complex buries approximately 16700 Å2 of the total combined solvent-accessible surface with nearly equal contributions from heavy and light Fab chains. Epitope and paratope residues involved in direct intermolecular contacts calculated within a 4.0 Å distance cut-off are listed in Table 17, and labeled in FIGS. 3A and 4A. A total of 25 Fab residues and 26 ENTPD2 residues are involved in direct intermolecular contacts, with heavy chain CDRs contributing more binding residues than light chain CDRs. Of these Fab paratope residues, CDR tyrosines contribute a large number of ENTPD2 contacts with 10 of 14 CDR Tyr residues involved. Heavy chain CDR residues in intermolecular contacts include CDR1 residues Ser31, Gly32, Tyr33, and Tyr34; CDR2 residues Tyr54, Asp55, Asp57; and CDR3 residues Tyr100, Tyr101, Arg102, Tyr103, Ser106, Tyr107, Asp112, Tyr113. Tyr27 of heavy chain FR1 also makes contact to the ENTPD2 antigen. Light chain CDR1 residues involved in ENTPD2 binding include Tyr31, Asp32, Gly33, and Tyr36 as well as CDR2 light chain residues Glu59, Ser60, and CDR3 residues Ser95, Asn96, and Asp 98. Glu1 whose side chain is disordered and not modeled in complex structure in addition to Gly61 of FR3 are within contact distance of N-linked glycosylation observed for Asn294 of ENTPD2 antigen and highlighted in FIG. 3A.

TABLE 17

Epitope and paratope residues FAb22/hENTPD2

| Human ENTPD2 epitope | | Anti-human ENTPD2 FAb22 paratope | |
|---|---|---|---|
| Structural element | Contact residues | Contact residues | Structural element |
| β3-α1 loop | Gly79 | Asp32L, Gly33L | L-CDR1 |
| α8 | Gln250 | Tyr103H | H-CDR3 |
|  | Leu253 | Tyr103H | H-CDR3 |
| α8-β10 loop | Trp266 | Tyr107H | H-CDR3 |
|  | Arg268 | Tyr54H, Asp55H, Asp57H | H-CDR2 |
|  | Gly269 | Tyr34H | H-CDR1 |
|  |  | Tyr54H, Asp55H | H-CDR2 |

TABLE 17-continued

Epitope and paratope residues FAb22/hENTPD2

| Human ENTPD2 epitope | | Anti-human ENTPD2 FAb22 paratope | |
|---|---|---|---|
| Structural element | Contact residues | Contact residues | Structural element |
|  | Phe270 | Tyr34H, Tyr54H | H-CDR1, H-CDR2 |
|  |  | Tyr101H, Tyr107H | H-CDR3 |
| β10 | Ser271 | Gly32H, Tyr33H, Tyr34H | H-CDR1 |
|  |  | Tyr54H, Tyr101H | H-CDR2, H-CDR3 |
|  | Thr272 | Tyr101H | H-CDR3 |
|  | Gln273 | Tyr33H, Tyr103H | H-CDR1, H-CDR3 |
|  |  | Tyr100H, Tyr101H, Tyr113H | H-CDR3 |
|  | Val274 | Tyr103H | H-CDR3 |
| β10-α9 loop | Leu275 | Arg102H | H-CDR3 |
| α9 | Asp278 | Tyr103H | H-CDR3 |
| β11 | Arg298 | Asp112H, Tyr113H | H-CDR3 |
|  |  | Glu59L, Ser60L | L-CDR2 |
|  | Ser300 | Tyr27H, Tyr33H | H-FR1, H-CDR1 |
|  | Ser302 | Ser31H, Gly32H | H-CDR1 |
|  |  | Tyr54H | H-CDR2 |
| β11-α10 loop | Gly303 | Tyr54H | H-CDR2 |
| α12-α13 loop | Thr380 | Asp57H | H-CDR2 |
| α13 | Trp381 | Tyr34H, Tyr101H | H-CDR1, H-CDR3 |
|  | Ala382 | Asp57H | H-CDR2 |
| α13-α14 loop | Gly390 | Tyr31L | L-CDR1 |
|  | Gln391 | Tyr31L | L-CDR1 |
| α14 | Arg392 | Tyr101H | H-CDR3 |
|  |  | Ser95L, Asn96L, Asp98L | L-CDR3 |
|  | Ala393 | Ser106H | H-CDR3 |
|  |  | Tyr31L, Tyr36L | L-CDR1 |
|  | Arg394 | Tyr31L, Asp32L | L-CDR1 |
|  | Asp397 | Tyr107H | H-CDR3 |

The lists of epitope and paratope residues in direct contact were derived from the final refined coordinates with the CCP4 program NCONT, using a 4.0 Å distance cut-off.

Example 6. Crystallography and Epitope Mapping of Anti-Human ENTPD2 FAb23

In this Example, anti-human ENTPD2 FAb23 was crystallized in complex with human ENTPD2 (Y350A mutant) ectodomain and the corresponding structure was determined. Analysis of anti-human ENTPD2 FAb23 binding to human ENTPD2 based on the X-ray data provided molecular details of antigen engagement and insights to the Fab paratopes and antigen epitopes revealed.

Materials and Methods

Preparation of Human ENTPD2 and Anti-Human ENTPD2 FAb23 Complex

To prepare the ENTPD2-FAb23 complex, a 1.6-fold molar excess of ENTPD2 was combined with the FAb23 in 20 mM Tris pH 7.5 with 100 mM NaCl and concentrated to 9.08 mg/mL by ultrafiltration, incubated on ice for 10 minutes, and submitted for crystallization trial set ups.

Crystallization and X-Ray Data Collection

The anti-hENTPD2 FAb23 complexed with human ENTPD2 Y350A mutant was crystallized in 96-well plates (Greiner Bio-One) by the method of vapor diffusion in sitting drops, at 20° C. In detail, 0.2 µl of protein stock was mixed with 0.2 µl of reservoir solution, and the drop was equilibrated against 50 µl of the same reservoir solution at 20° C. The experiments were set up with a Phoenix robotic system (Art Robbins Instruments), and stored in in-house custom engineered crystal imager and gantry (Novartis GNF internal systems).

For X-ray data collection, one crystal was directly mounted in a cryo-loop and flash cooled into liquid nitrogen. X-ray data sets were collected at the Advanced Light Source, BL5.03, with Quantum Q315r CCD detector, using 0.9765 Å X-ray radiation. 140 images of 1.0° oscillation each were recorded at a crystal-to-detector distance of 300 mm and processed with HKL2000 (Z. Otwinowski and W. Minor, "Processing of X-ray Diffraction Data Collected in Oscillation Mode", Methods in Enzymology, Volume 276: Macromolecular Crystallography, part A, p. 307-326, 1997, C. W. Carter, Jr. & R. M. Sweet, Eds., Academic Press (New York).

Structure Determination and Analysis

The structure of the FAb23-ENTPD2 complex was determined by molecular replacement with the program Phaser (McCoy et al., 2007, J Appl Crystallogr 40:658-674), using the refined coordinates of human ENTPD2 previously determined in house and a homology model of the FAb23 generated with the antibody modeler tool in MOE software (Molecular Operating Environment (MOE), 2013 August; Chemical Computing Group ULC, 1010 Sherbooke St. West, Suite #910, Montreal, QC, Canada, H3A 2R7, 2018) which showed high sequence similarity to the Fab fragment of ICSM 18-anti-PRP (PDB code 4W9D) as independent search models. The structure was refined using iterative cycles of model building followed by automated crystallographic refinement with the programs Coot 0.8.0 (Crystallographic Object-Oriented Toolkit; Emsley et al., 2010, Acta Crystallogr Sect D: Biol Crystallogr; 66:486-501) and Autobuster 2.11.5 (Bricogne et al., 2011, BUSTER version 2.11.2. Cambridge, United Kingdom: Global Phasing Ltd.).

Visual inspection of the crystal structure was carried out using the programs Coot (Emsley et al., 2010, Acta Crystallogr Sect D: Biol Crystallogr; 66:486-501) and PyMOL (Molecular Graphics System; DeLano Scientific: Palo Alto, CA). The quality of the final refined models was assessed with the programs Coot and PROCHECK v3.3 (Laskowski et al., 1992, J Appl Crystallogr; 26:283-291). Residues of human ENTPD2 that become less accessible to solvent upon binding of the anti-human ENTPD2 MAB17 Fab were identified by the program AREAIMOL of the CCP4 program suite (Collaborative Computational Project, Number 4, 1994). Intermolecular contacts were defined using a cut-off distance of 4.0 Å and were identified with the CCP4 program NCONT.

Results

Crystal Structure of the Anti-hENTPD2 FAb23/ENTPD2 Complex

The anti-hENTPD2 FAb23 complexed with human ENTPD2 Y350A mutant was crystallized in 96-well plates by the method of vapor diffusion in sitting drops, at 20° C. Crystals grew in 0.08M Bis-Tris propane pH 8.8, 0.02M citric acid, 16% PEG3350. Crystals appeared after approximately 6 weeks and grew to full size within a few days.

The crystal of the FAb23-ENTPD2 complex was in monoclinic space group P21, with one complex per asymmetric unit. A complete diffraction data set was collected for the complex to 2.0 Angstrom resolution. The final model for the FAb23 complexed with ENTPD2 was refined with AutoBuster with good refinement statistics and overall geometry. A total of four Ramachandran outliers were present in the final model with two residues from the FAb23 light chain (Ser39 and Thr50) and two from ENTPD2 (Thr122 and Ala430). Electron density was poor for Ser39 of the Fab light chain and tentatively modeled. All other residues were adequately defined in the electron density and likely genuine Ramachandran outliers. ENTPD2 residues omitted from final model include residues 29-34 of the N-terminus and residues beyond 448 of the C-terminus. Residues 139-144 of the FAb23 chain constant region and the terminal cysteine (Cys227) were also omitted from the final model. The last two residues of the FAb23 light chain (Glu212 and Cys213) were also absent from final model due to disorder.

Figure 7:
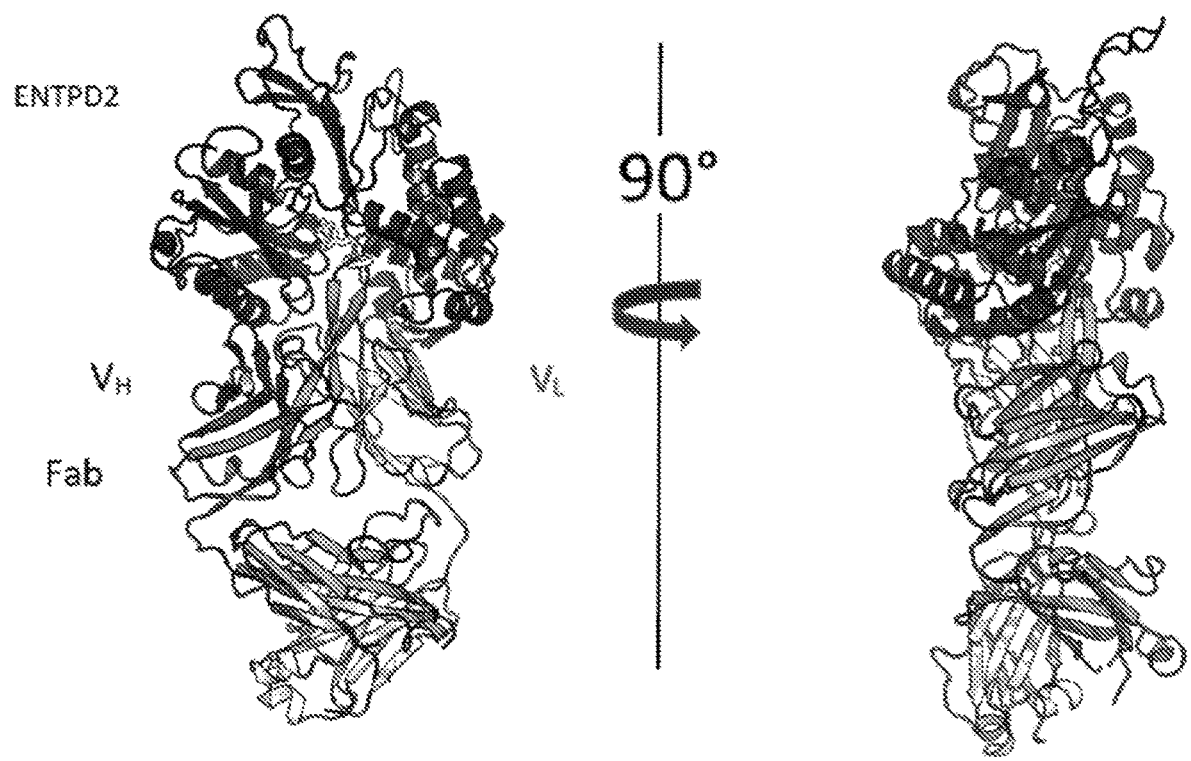
FIG. 7 illustrates an overview of anti-human ENTPD2 FAb23 in complex with human ENTPD2. Two views are shown 90 degrees apart. AMP-PNP is modeled in the ENTPD2 active site based upon superposition with the rat ENTPD2 co-structure PDB 3CJA. The heavy chain of the Fab is shaded darker.

The amino-acid sequences of the anti-human ENTPD2 FAb23 heavy chain and light chains are provided in FIG. 3B, with the CDRs underlined (as defined by Kabat, 1991, Sequences of proteins of immunological interest, NIH Publication No. 91-3242) and residues located at the Fab-antigen interface labeled with *. An overall view of the three dimensional structure of the FAb23/ENTPD2 Y350A complex is depicted in FIG. 7.

In contrast to FAb22, binding of the FAb23 to ENTPD2 involves significant engagement of both membrane proximal and distal lobes by both heavy and light chain variable domains. Heavy chain variable region loops CDR2 and CDR3 participate in ENTPD2 binding, with no contribution from CDR1. Residues from all 3 CDRs from the light chain variable region are involved in ENTPD2 binding Contacts with the ENTPD2 membrane distal lobe are largely conferred by residues from heavy chain CDR3, light chain CDR2, and light chain FR3 residues binding to residues of the ENTPD2 loop region residues between α13 and α14, as well as FR3 interactions with antiparallel strands β10/β11 and helix α9. CDR3 light chain and CDR2 heavy chain residues confer extensive binding to α2 helix and loop residues connecting β3 and α1 of the membrane proximal lobe of ENTPD2. Heavy chain CDR3 projects terminal residues Tyr104, Tyr105, and Gly106 into the ENTPD2 active site cleft between N-terminal ends of helices α8, α11, and α14 of the membrane distal lobe. Superposition of the ATP analog AMP-PNP from bound rat ENTPD2 crystal structure PDB 3CJA suggest Tyr105 is positioned where the adenine ring of ATP would be predicted to bind, potentially sterically obstructing substrate binding. Tyr105 and Tyr104 of the heavy chain CDR3 terminus may also perturb ENTPD2 active site residues including Tyr350 and Arg394 necessary for π-π and cation-π stacking interactions with the adenine ring of substrate ATP. Binding of the FAb23 to ENTPD2 buries approximately 17500 Å2 of combined solvent-accessible surface. Epitope and paratope residues involved in direct intermolecular contacts calculated within a 4.0 Å distance cut-off are listed in Table 18, and labeled in FIGS. 3B and 4A. 25 Fab residues and 29 ENTPD2 residues were involved in direct intermolecular contacts. Heavy chain residues Tyr55, Ile57, Thr59, Gln62 of CDR2, as well as Phe102, Tyr105, Ile107, Tyr110 of CDR3 contribute to ENTPD2 binding with no contribution from CDR1 residues. Light chain residues contributing to ENTPD2 binding include Ser27 and Tyr31 from CDR1, Ser49 and Asn52 from CDR2, and Trp90, Ser91, Ser92, Tyr93, and Trp95 of CDR3. Non-CDR light chain residues contributing to ENTPD2 binding include Glu1, which is observed and modeled as pyroglutamate in the crystal structure, Thr22 of FR1, and Ser64, Gly65, Ser66, Gly67, Thr68, and Phe69 of FR3.

TABLE 18

Epitope and paratope residues FAb23/human ENTPD2

| Human ENTPD2 epitope | | Anti-human ENTPD2 FAb23 paratope | |
| --- | --- | --- | --- |
| Structural element | Contact residues | Contact residues | Structural element |
| β1-β2 loop | His50 | Ile107H | H-CDR3 |
| β3 | Asp76 | Ile107H | H-CDR3 |
| β3-α1 loop | Pro78 | Tyr110H, Trp95L | H-CDR3, L-CDR3 |
|  | Gly79 | Trp90L, Ser91L | L-CDR3 |
|  | Gly80 | Ser91L | L-CDR3 |
| α1 | Tyr85 | Ser91L, Ser92L, Tyr93L | L-CDR3 |
| α1-α2 loop | Asp87 | Ser27L | L-CDR1 |
|  | Asn88 | Glu1L, Tyr93L | L-FR1, L-CDR3 |
| α2 | Gly91 | Tyr93L | L-CDR3 |
|  | Gln94 | Gln62H, Tyr93L | H-CDR2, L-CDR3 |
|  | Ser95 | Tyr93L | L-CDR3 |
|  | Gly98 | Ile57H, Thr59H | H-CDR2 |
|  | Glu101 | Ile57H | H-CDR2 |
|  | Gln102 | Tyr55H, Ile57H | H-CDR2 |
|  | Gln105 | Tyr55H, Ile57H | H-CDR2 |
|  | Asp106 | Tyr55H | H-CDR2 |
| α8 | Arg245 | Tyr104H, Tyr105H | H-CDR3 |
| β10 | Thr272 | Ser64L, Gly65L | L-FR3 |
|  | Gln273 | Phe69L | L-FR3 |
|  | Leu275 | Thr68L, Phe69L | L-FR3 |
| α9 | Asp278 | Ser66L, Gly67L, Thr68L, Phe69L | L-FR3 |

TABLE 18-continued

Epitope and paratope residues FAb23/human ENTPD2

| Human ENTPD2 epitope | | Anti-human ENTPD2 FAb23 paratope | |
|---|---|---|---|
| Structural element | Contact residues | Contact residues | Structural element |
| β11 | Arg298 | Thr22L, Phe69L | L-FR1, L-FR3 |
| β12-α11 loop | Ala347 | Tyr105H | H-CDR3 |
| α11 | Ala350 | Tyr105H | H-CDR3 |
|  | Thr351 | Tyr105H | H-CDR3 |
| α13-α14 loop | Arg392 | Asn52L | L-CDR2 |
|  | Ala393 | Phe102H, Tyr104H, Ser49L | H-CDR3, L-CDR2 |
|  | Arg394 | Tyr104H, Tyr31L | H-CDR3, L-CDR1 |
| α14 | Tyr398 | Tyr104H, Tyr105H | H-CDR3 |

The lists of epitope and paratope residues in direct contact were derived from the final refined coordinates with the CCP4 program NCONT, using a 4.0 Å distance cut-off.

Example 7. Crystallography and Epitope Mapping of Anti-Mouse ENTPD2 FAb24

In this Example, anti-murine ENTPD2 Fab MAB13 was crystallized in complex with murine ENTPD2 ectodomain and the corresponding structure was determined. Analysis of anti-mouse ENTPD2 FAb24 binding to murine ENTPD2 based on the X-ray data provided molecular details of antigen engagement and insights to the Fab paratopes and antigen epitopes revealed.

Materials and Methods

Preparation of Murine ENTPD2 and Anti-Mouse ENTPD2 FAb24 Complex

To prepare the murine ENTPD2 FAb24 complex, purified murine ENTPD2 and FAb24 in 20 mM Tris pH 7.5 with 100 mM NaCl were combined in 1:1 molar ratio, incubated on ice at 4 degrees Celcius overnight. The following morning, sample was concentrated to 9.88 mg/mL by ultrafiltration, and submitted for crystallization trial set ups.

Crystallization and X-Ray Data Collection

The anti-mouse ENTPD2 FAb24 complexed with ENTPD2 Y350A mutant was crystallized in 96-well plates (Greiner Bio-One) by the method of vapor diffusion in sitting drops, at 20° C. In detail, 0.2 μl of protein stock was mixed with 0.2 μl of reservoir solution, and the drop was equilibrated against 50 μl of the same reservoir solution at 20° C. The experiments were set up with a Phoenix robotic system (Art Robbins Instruments), and stored in in-house custom engineered crystal imager and gantry (Novartis GNF internal systems).

For X-ray data collection, one crystal was directly mounted in a cryo-loop and flash cooled into liquid nitrogen. X-ray data sets were collected at the SSRL, beamline 7-1, using 1.1808 Å X-ray radiation, equipped with an ADSC Quantum 315r CCD detector. 340 images of 0.5° oscillation each were recorded at a crystal-to-detector distance of 400 mm and processed with HKL2000 (Z. Otwinowski and W. Minor, "Processing of X-ray Diffraction Data Collected in Oscillation Mode", Methods in Enzymology, Volume 276: Macromolecular Crystallography, part A, p. 307-326, 1997, C. W. Carter, Jr. & R. M. Sweet, Eds., Academic Press (New York).

Structure Determination and Analysis

The FAb24-mouse ENTPD2 complex structure was determined by molecular replacement with the program Phaser (McCoy et al., 2007, J Appl Crystallogr 40:658-674), using the refined structures of murine ENTPD2 and FAb24 previously determined in house as independent search models. The structure was refined using iterative cycles of model building followed by automated crystallographic refinement with the programs Coot 0.8.0 (Crystallographic Object-Oriented Toolkit; Emsley et al., 2010, Acta Crystallogr Sect D: Biol Crystallogr; 66:486-501) and Autobuster 2.11.5 (Bricogne et al., 2011, BUSTER version 2.11.2. Cambridge, United Kingdom: Global Phasing Ltd.).

Visual inspection of the crystal structure was carried out using the programs Coot (Emsley et al., 2010, Acta Crystallogr Sect D: Biol Crystallogr; 66:486-501) and PyMOL (Molecular Graphics System; DeLano Scientific: Palo Alto, CA). The quality of the final refined models was assessed with the programs Coot and PROCHECK v3.3 (Laskowski et al., 1992, J Appl Crystallogr; 26:283-291). Residues of murine ENTPD2 that become less accessible to solvent upon binding of the anti-mouse ENTPD2 FAb24 were identified by the program AREAIMOL of the CCP4 program suite (Collaborative Computational Project, Number 4, 1994). Intermolecular contacts were defined using a cut-off distance of 4.0 Å and were identified with the CCP4 program NCONT.

The FAb24-mouse ENTPD2 complex structure was determined by molecular replacement with the program Phaser (McCoy et al., 2007, J Appl Crystallogr 40:658-674), using the refined structures of murine ENTPD2 and FAb24 previously determined in house as independent search models. The structure was refined using iterative cycles of model building followed by automated crystallographic refinement with the programs Coot 0.8.0 (Crystallographic Object-Oriented Toolkit; Emsley et al., 2010, Acta Crystallogr Sect D: Biol Crystallogr; 66:486-501) and Autobuster 2.11.5 (Bricogne et al., 2011, BUSTER version 2.11.2. Cambridge, United Kingdom: Global Phasing Ltd.).

Results

Crystal Structure of the Anti-Mouse ENTPD2 FAb24/Mouse ENTPD2 Complex

The anti-mouse ENTPD2 FAb24 complexed with murine ENTPD2 was crystallized in 96-well plates by the method of vapor diffusion in sitting drops, at 20° C. Crystals grew in 0.2M tri-ammonium citrate pH 7.0, 20% PEG3350. Crystals appeared after approximately 1 month and grew to full size within a few days.

The FAb24-mouse ENTPD2 complex crystal was in monoclinic space group P21, with one complex per asymmetric unit. A complete diffraction data set was collected for the complex to 3.0 Angstrom resolution. The final model for the FAb24 complexed with mouse ENTPD2 was refined with AutoBuster with good refinement statistics and overall geometry. Two Ramachandran outliers Thr122 of mouse ENTPD2 and Ala57 of the FAb24 were present in final model, both of which were well-defined in electron density. Asn129 and Asn378 were only residues where N-linked glycosylation was observed. Glu1 of the FAb24 heavy chain was observed and modeled as pyroglutamate. Mouse ENTPD2 residues omitted from final model include residues 29-35 of the N-terminus, 61-66 corresponding to loop residues connecting strands β2 and β3, residues 182-194 corresponding to the membrane interacting loop (MIL), loop residues 290-293 between α9 and β11, and C-terminal residues beyond Ala450. All heavy and light chain residues of the FAb24 were included in the final refined model except the terminal cysteine of the heavy chain Cys225.

Figure 8:
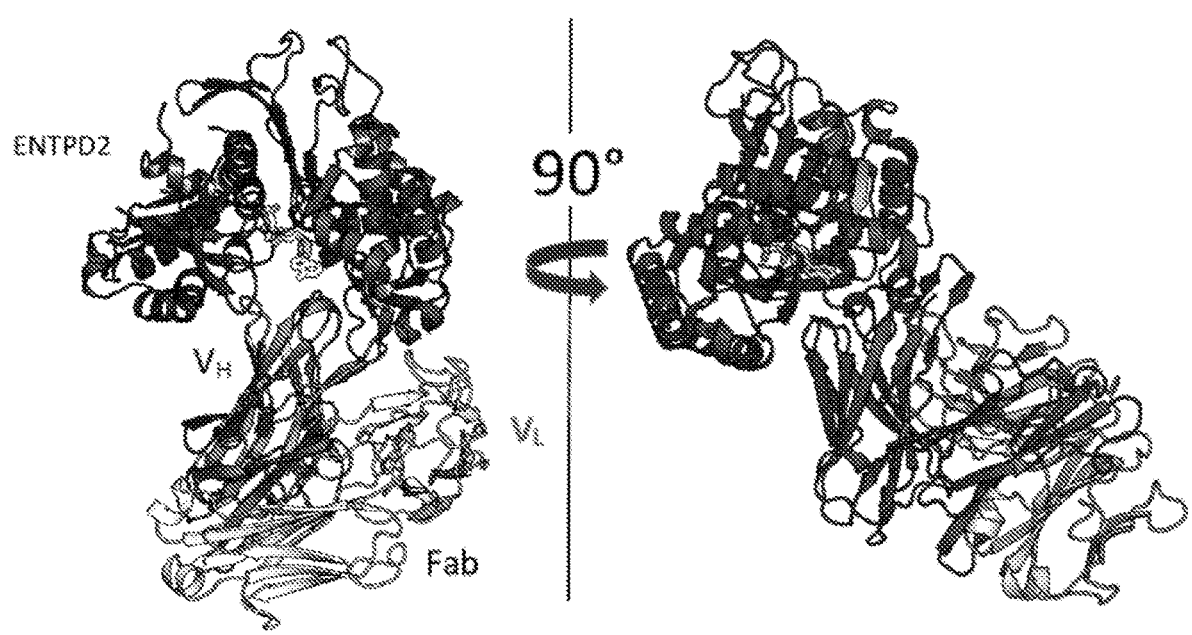
FIG. 8 illustrates an overview of anti-murine ENTPD2 FAb24 in complex with mouse ENTPD2. AMP-PNP is modeled in the ENTPD2 active site based upon superposition with the rat ENTPD2 co-structure PDB 3CJA. The heavy chain of the Fab is shaded darker.

The amino-acid sequences of the anti-mouse ENTPD2 FAb24 heavy and light chains are provided in FIG. 3C, with the CDRs underlined (as defined by Kabat, 1991, Sequences of proteins of immunological interest, NIH Publication No. 91-3242) and residues located at the Fab-antigen interface labeled with *. An overall view of the three dimensional structure of the FAb24/mENTPD2 complex is depicted in FIG. 8.

Anti-mouse ENTPD2 FAb24 engages predominantly the presumed membrane distal lobe (residues G162-E426) of the ENTPD2 antigen. An equal contribution to ENTPD2 binding is observed for CDR residues of the heavy chain and light chain variable domains.

Compared to FAb22 and FAb23 binding to human ENTPD2, the FAb24 engages the murine ENTPD2 from an entirely different direction orthogonal to what is observed in FAb22 and FAb23 complexes with hENTPD2. The FAb24 binds predominantly the murine ENTPD2 membrane distal lobe through extensive heavy chain CDR interactions and relatively few light chain CDR interactions. Heavy chain CDR1 and CDR3 residues in conjunction with light chain CDR1 and CDR2 residues bind to helices α11 and α13 of mENTPD2. Residues of heavy chain CDR2 make interactions with the interconnecting loop residues between α13 and α14. The CDR3 heavy chain CDR3 is observed in a conformation where it is bent nearly 90 degrees and adopts a short β-turn motif at its terminal end. Two residues of the FR3 heavy chain make sole contacts to the mouse ENTPD2 proximal lobe through interactions with β3 of the 5-stranded antiparallel sheet. No MAB13 CDRs are observed to extend far enough into the mouse ENTPD2 site to affect ATP hydrolysis activity through direct obstruction of the substrate binding site. Binding of FAb24 to murine ENTPD2 buries approximately 16300 $Å^2$ total combined solvent-accessible surface. Epitope and paratope residues involved in direct intermolecular contacts calculated within a 4.0 Å distance cut-off are listed in Table 19 and labeled in FIGS. 3C and 4B. 22 Fab residues and 18 murine ENTPD2 residues were involved in direct intermolecular contacts and comprise the observed paratope and epitope in Fab/ENTPD2 engagement. Heavy chain CDR residues include CDR1 Thr28, Thr30, His31, Tyr32, and Gly33; CDR2 Trp50, Asn52, Thr53, and Asp54, Thr55; CDR3 Tyr99, Gly100, Thr101, Leu102, Tyr103, and Phe110. Two FR3 residues Thr74 and Ser75 from the heavy chain also contribute to binding Light chain CDR residues contributing to binding include Thr34 and Lys36 from CDR1, Tyr56 from CDR2, and Trp97 from CDR3.

TABLE 19

Epitope and paratope residues FAB24/mouse ENTPD2

| Mouse ENTPD2 epitope | | Anti-mouse ENTPD2 FAb24 paratope | |
|---|---|---|---|
| Structural element | Contact residues | Contact residues | Structural element |
| β3 | Ser74 | Ser75H | H-FR3 |
| | Cys75 | Ser75H | H-FR3 |
| | Asp76 | Thr74H, Ser75H | H-FR3 |
| α11 | Tyr349 | Thr28H | H-CDR1 |
| | Tyr350 | Thr28H, His31H | H-CDR1 |
| | Asp353 | Thr28H, His31H | H-CDR1 |
| | Phe354 | His31H | H-CDR1 |
| | Thr357 | Tyr32H | H-CDR1 |
| | | Thr101H, Leu102H, Tyr103H | H-CDR3 |
| | Val358 | Tyr32H | H-CDR1 |
| | | Thr101H, Tyr103H | H-CDR3 |
| α11-α12 loop | Gly360 | Tyr103H | H-CDR3 |
| α13 | Gln385 | Thr34L | L-CDR1 |
| | Ala386 | Phe110H | H-CDR3 |
| | | Lys36L | L-CDR1 |
| | | Tyr56L | L-CDR2 |
| | Arg387 | Gly100H, Thr101H | H-CDR3 |
| α13-α14 loop | Val388 | His31H | H-CDR1 |
| | Pro389 | Tyr99H, Gly100H, Phe110H | H-CDR3 |
| | | Trp97L | L-CDR3 |
| | Gly390 | Trp50H | H-CDR2 |
| | Gln391 | Thr30H, Tyr32H, Gly33H | H-CDR1 |
| | | Trp50H, Asn52H, Thr53H, Asp54H | H-CDR2 |
| | Thr393 | Asp54H, Thr55H | H-CDR2 |
| | Arg394 | Asp54H | H-CDR2 |
| α14 | Tyr398 | His31H | H-CDR1 |

The lists of epitope and paratope residues in direct contact were derived from the final refined coordinates with the CCP4 program NCONT, using a 4.0 Å distance cut-off.

Example 8. Inhibition of Tumor Growth by Anti-ENTPD2 MAB13 in Combination with Anti-PD-1 Ab in the Syngeneic B16LM3 Tumor Model B16LM3 model was established in female C57BL/6 mice by subcutaneous injection of $0.5 \times 10^6$ cells into the right flank of each mouse. The day after implant mice were randomized into treatment groups (n=10 per group). Mice received treatments of either anti-mouse ENTPD2 mAb13 or a non-specific mIgG2a isotype control (clone MOPC-173, BioLegend, San Diego, CA) at a final dose 15 mg/kg on Day 1, 5, 8, 12, 15.

Anti-PD-1 Ab (clone RMP1-14 Bio X Cell, West Lebanon, NH) or non-specific rIgG2a isotype control (clone RTK2758, BioLegend, San Diego, CA) were delivered i.p. at a final dose of 10 mg/kg on days 1, 5, 8, 12, 15. All doses were adjusted to individual mouse body weights.

Figure 9:
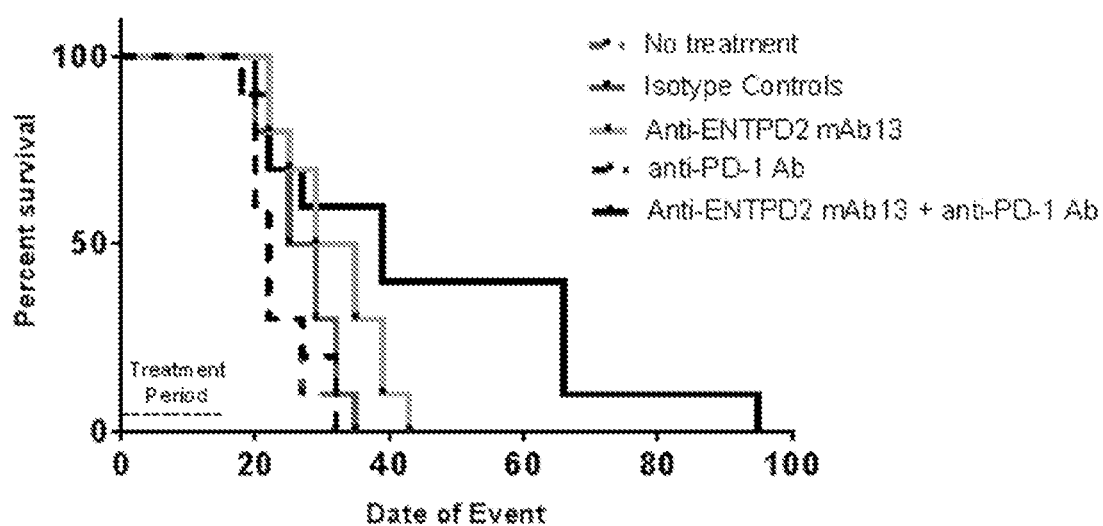
FIG. 9 is a plot illustrating long-term efficacy with anti-mouse ENTPD2 mAb13 in combination with anti-PD-1 Ab in the syngeneic B16LM3 tumor model.

All test agents were tolerated on study and no overt clinical symptoms of toxicities or body weight loss were observed in any of the treatment groups. Combination of anti-mouse ENTPD2 mAb13 with anti-PD-1 Ab treatment significantly extended mouse survival relative to No Treatment ($p<0.005$), Isotype Control ($p<0.05$) or anti-PD-1 Ab ($p<0.01$) (Log-rank (Mantel-Cox) test was used to determine if survival curves were significantly different)) (FIG. 9).

Example 9. Combination Treatment of Anti-ENTPD2 mAb13 with Anti-PD-1 Ab in the Syngeneic B16F10 Tumor Model Induces Tumor Influx of Activated T Cells B16F10 model was established in female C57BL/6 mice by subcutaneous injection of $0.5 \times 10^6$ cells into the right flank of each mouse. On day 7 once tumors reached approximately 30 mm$^3$, mice were randomized according to tumor volume into treatment groups (n=10 per group). Mice received treatment of either anti-mouse ENTPD2 mAb13 at a final dose 15 mg/kg, anti-PD-1 Ab (clone RMP1-14 Bio X Cell, West Lebanon, NH) i.p. at a final dose of 10 mg/kg or the combination of both treatments on days 1, 5, and 8. All doses were adjusted to individual mouse body weights.

Figure 10A:
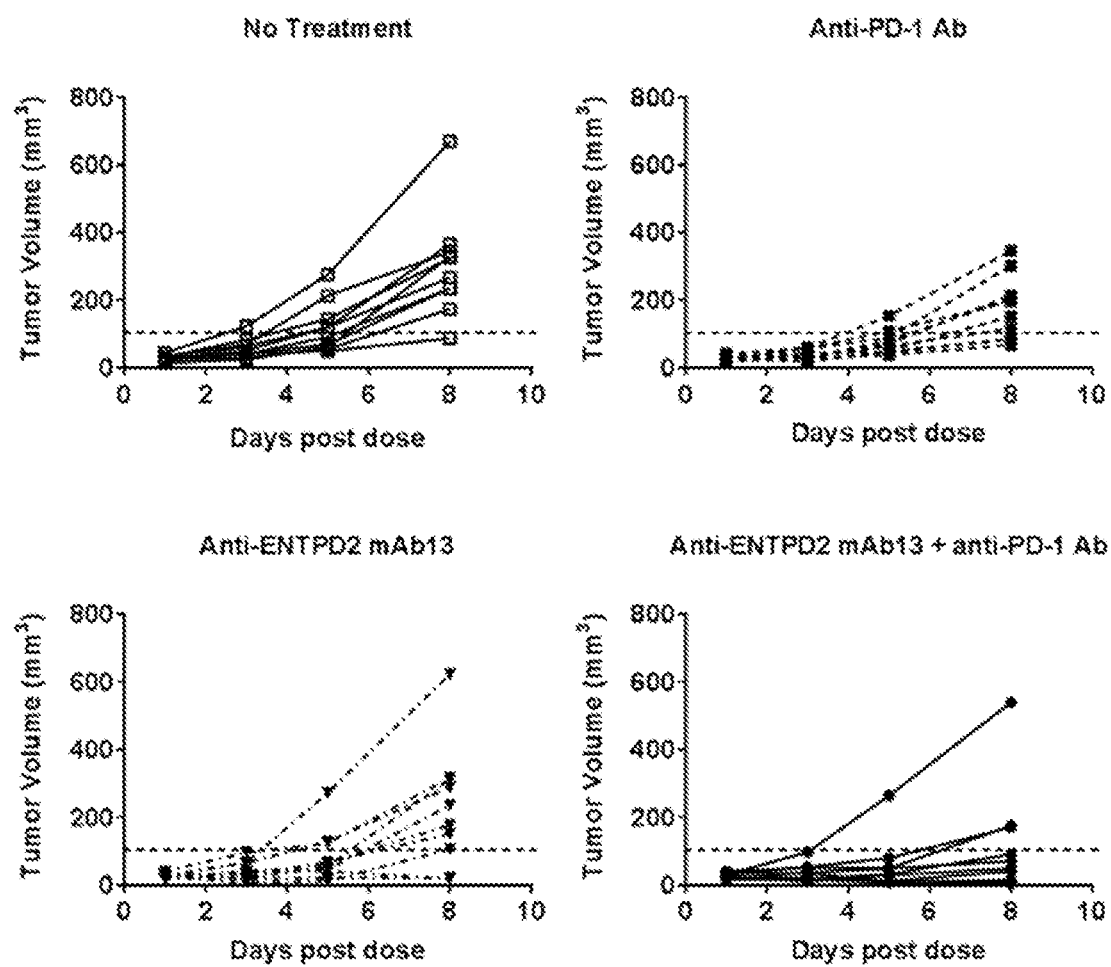
FIGS. 10A-10C are graphs illustrating efficacy with anti-mouse ENTPD2 mAb13 in combination with anti-PD-1 Ab in the syngeneic B16F10 tumor model, associated with increased influx of activated CD8 and CD4 T helper cells at the tumor site on day 8 post treatment.
Figure 10B:
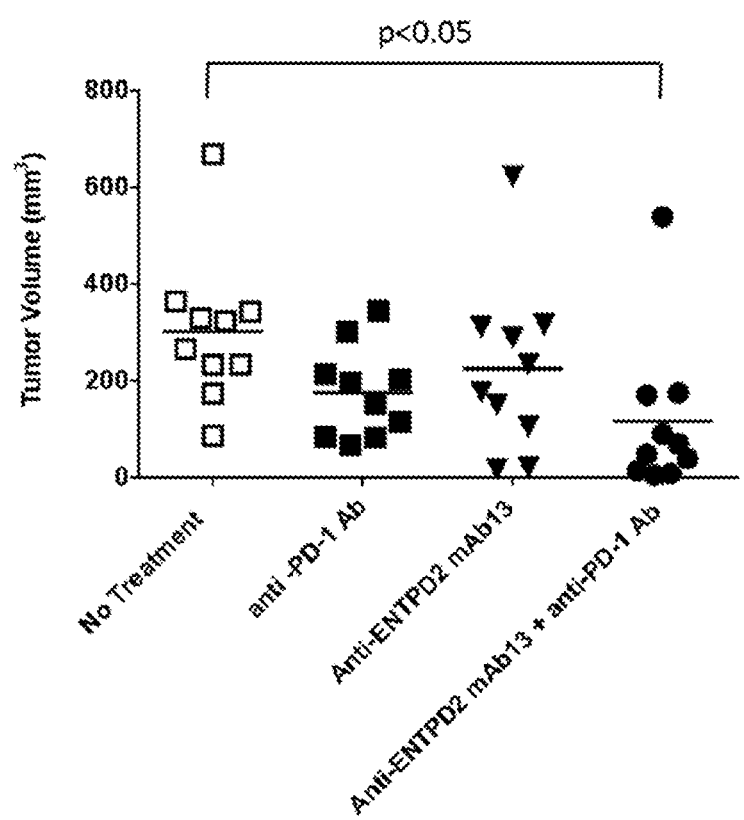

No significant anti-tumor efficacy was observed after treatment with anti-mouse ENTPD2 mAb13 or anti-PD-1 Ab alone, however a significant reduction in tumor growth relative to No Treatment control was observed in the combination arm of anti-mouse ENTPD2 mAb13 and anti-PD-1 Ab ($p<0.05$ One-Way ANOVA/Tukey's Multiple Comparisons Test) (FIGS. 10A-10B).

In order to understand the impact of treatments on the tumor microenvironment, mice were euthanized on day 8 and tumors were dissociated in HyClone RPMI1640 media (GE Healthcare, Pittsburgh, PA) using gentleMacs C-tubes (Miltenyi Biotec, Auburn, CA) on the gentleMacs Octo Dissociator (Miltenyi Biotec, Auburn, CA). Approximately $2 \times 10^6$ dissociated tumor cells were blocked with rat anti-mouse CD16/CD32 Ab (Biolegend, San Diego, CA) to reduce non-specific FcγRIII/II binding and subsequently stained with the following cocktail of Abs: rat anti-mouse CD45-BUV395 (clone 30-F11) (BD Biosciences, San Jose, CA), rat anti-mouse CD8a-BUV737 (clone 53-6.7) (BD Biosciences, San Jose, CA), rat anti-mouse CD4-BV510 (clone RM4-5) (BD Bioscience, San Jose CA), anti-mouse CD69-PercPCy5.5 (clone H1-2F3) (Biolegend, San Diego, CA) and rat anti-mouse CD25-eFluor450 (clone eBio3C7) (eBioscience, San Diego, CA) at the manufacturers' recommended dilutions. All incubations and washes were performed in FACS Buffer composed of 1× HyClone Phosphate Buffered Saline (GE Healthcare, Pittsburgh, PA), 1% HyClone Fetal Bovine Serum (GE Healthcare, Pittsburgh, PA), 2 mM EDTA (ThermoFisher, Waltham MA). After staining with the cell surface antigen antibody cocktail, dissociated tumor cells were washed in FACS buffer, fixed and permeabilized using the eBioscience Foxp3/Transcription Factor Staining Buffer Kit (ThermoFisher, Waltham MA) to allow for intracellular staining with the mouse anti-mouse FOXP3-eFluor660 (clone 150D/E4) (eBioscience, San Diego, CA).

Figure 10C:
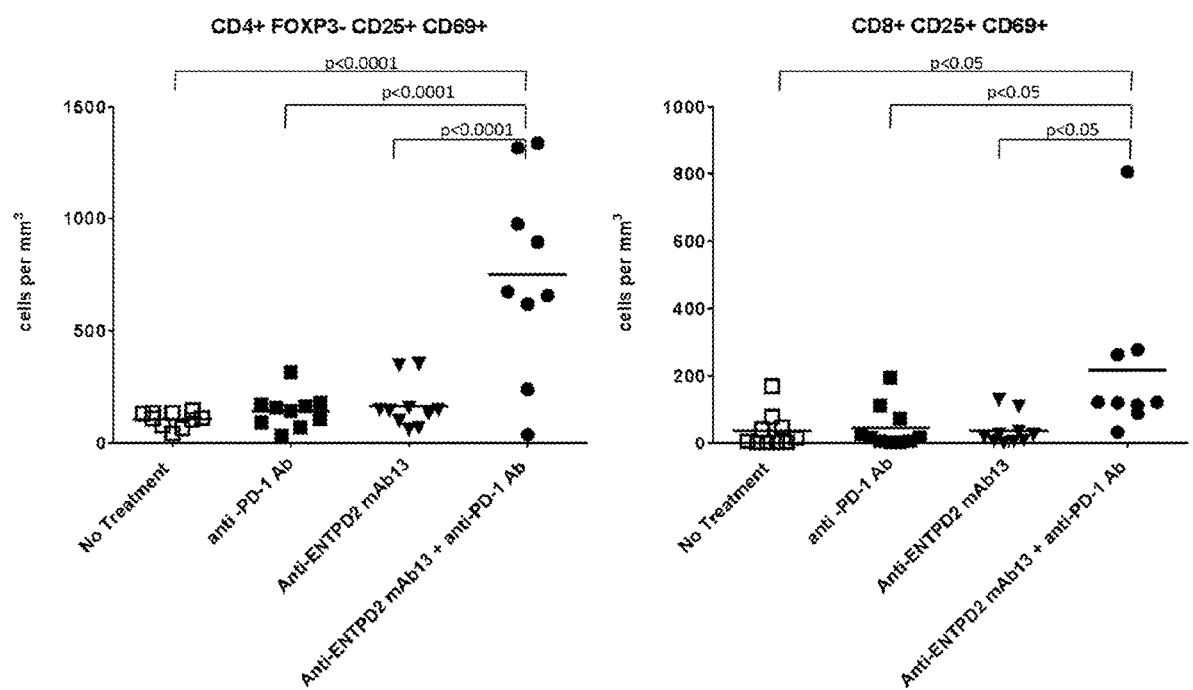

A significant influx of activated CD4 T-helper cells (defined as CD45+ CD8− CD4+ FOXP3− CD69+ CD25+) (7.0-fold increase vs No Treatment, $p<0.0001$ One-Way ANOVA/Tukey's Multiple Comparisons Test) and CD8 T cells (defined as CD45+ CD4− CD8+ CD69+ CD25+) (5.8-fold change vs No Treatment, $p<0.05$ One-Way ANOVA/Tukey's Multiple Comparisons Test) was observed with the Anti-mouse ENTPD2 mAb13 and Anti-PD-1 Ab combination treatment relative to all other treatment groups (FIG. 10C).

Figure 11A:
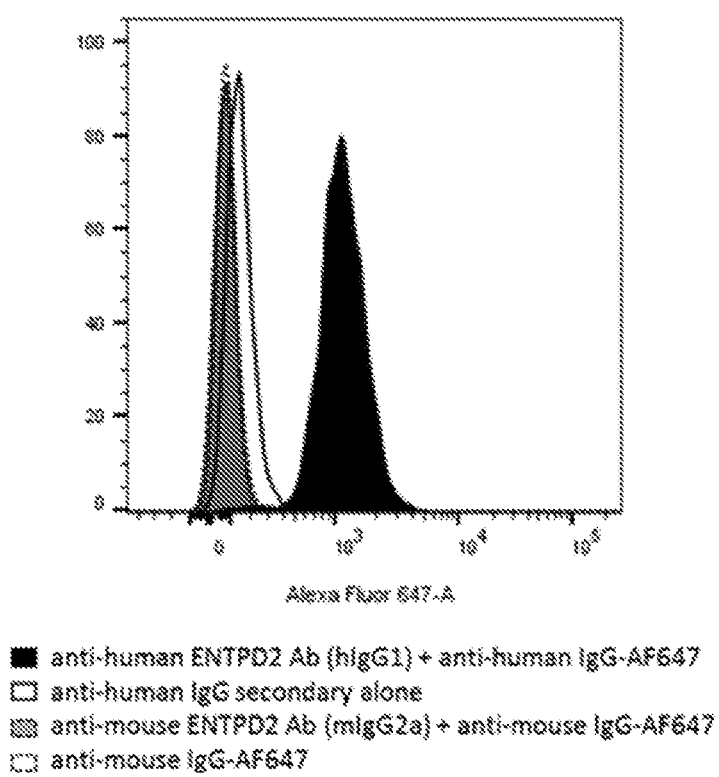
FIGS. 11A-11B depict characterization of the human ENTPD2 engineered model B16LM3 clone B5, illustrating expression of human ENTPD2 by FACS in vitro and sustainability of human ENTPD2 expression in tumors in vivo by IHC with the Novus anti-human CD39L1 Ab (1:40 dilution).
Figure 11B:
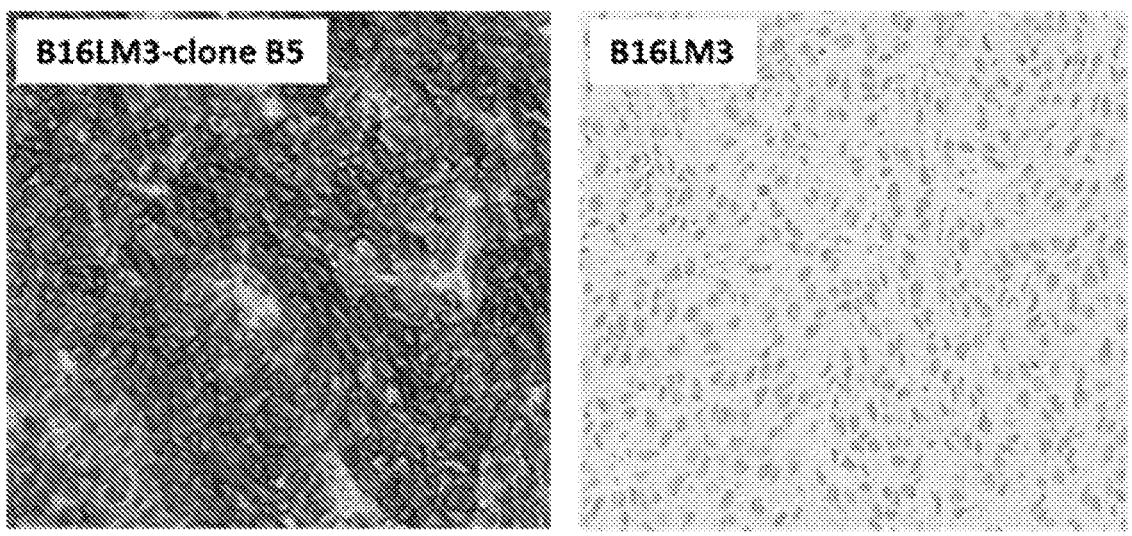

Example 10. Dose Dependent In Vivo Efficacy of Anti-Human ENTPD2 mAb1 and mAb6 in Combination with Anti-PD-1 Ab in the Human ENTPD2 Engineered B16LM3 Xenograft Model in C57BL/6 Mice To demonstrate targeted anti-tumor activity of anti-human ENTPD2 Abs in vivo, a human ENTPD2-engineered model was developed, B16LM3 clone 5. This model was derived from the B16LM3 melanoma model, where endogenous mouse ENTPD2 expression was knocked out via a transient electroporation of CAS9 protein with CRISPR guide RNA sequences against mouse ENTPD2, and human ENTPD2 was overexpressed using a retroviral transduction approach. Human ENTPD2 expression in the model was confirmed in vitro by FACS with the human ENTPD2 selective anti-human ENTPD2 mAb17. Mouse ENTPD2 selective anti-mouse ENTPD2 mAb13 was used to demonstrate complete knockout of endogenous mouse ENTPD2 (FIG. 11A). B16LM3 clone B5 demonstrated comparable growth kinetics to the parental line and sustained human ENTPD2 expression in the syngeneic host (FIG. 11B).

Human ENTPD2 engineered B16LM3 clone B5 model was established in female C57BL/6 mice by subcutaneous injection of $0.5 \times 10^6$ cells into the right flank of each mouse. Once tumors reached approximately 35-50 mm$^3$, mice were randomized according to tumor volume into treatment groups (n=8 per group). Mice received an i.v. treatment of either anti-human ENTPD2 mAb1 or mAb6 at a final dose of 0.1, 1 or 10 mg/kg or a non-specific human IgG1 isotype control 10 mg/kg on day 1 of study. Anti-PD-1 Ab (clone RMP1-14 Bio X Cell, West Lebanon, NH) was dosed i.p. at a final dose of 10 mg/kg on D1 and D5. All doses were adjusted to individual mouse body weights. All test agents were tolerated on study and no overt clinical symptoms of toxicities or body weight loss were observed in any of the treatment groups (Table 23).

Figure 12A:
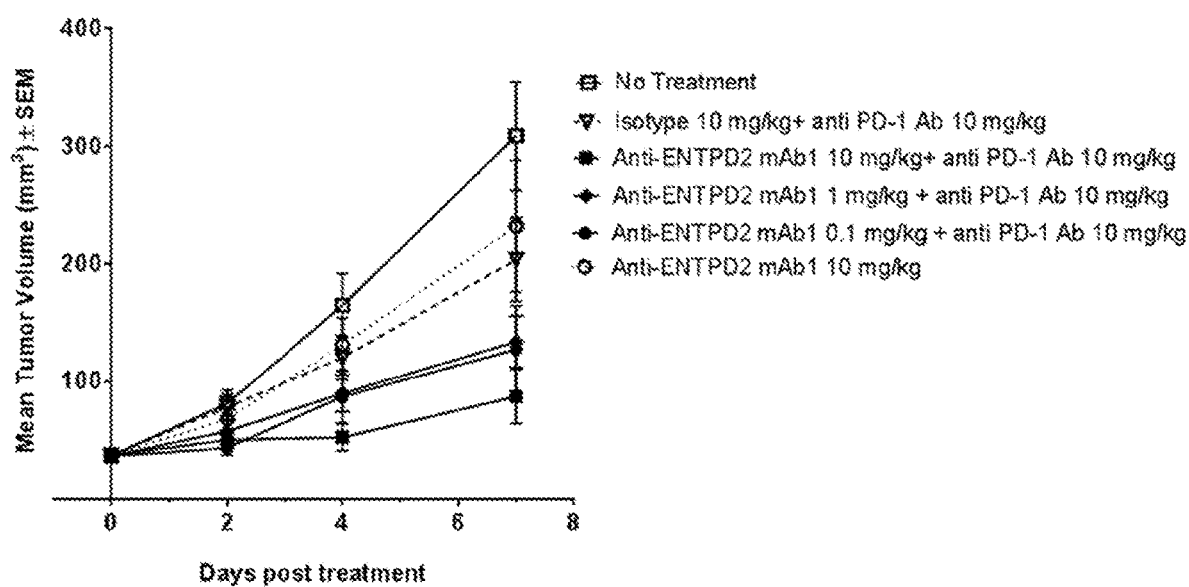
FIGS. 12A-12B are graphs illustrating dose response efficacy of anti-human ENTPD2 mAb1 and mAb6 in combination with anti-PD-1 Ab in the human ENTPD2 engineered B16LM3 clone B5 model.
Figure 12B:
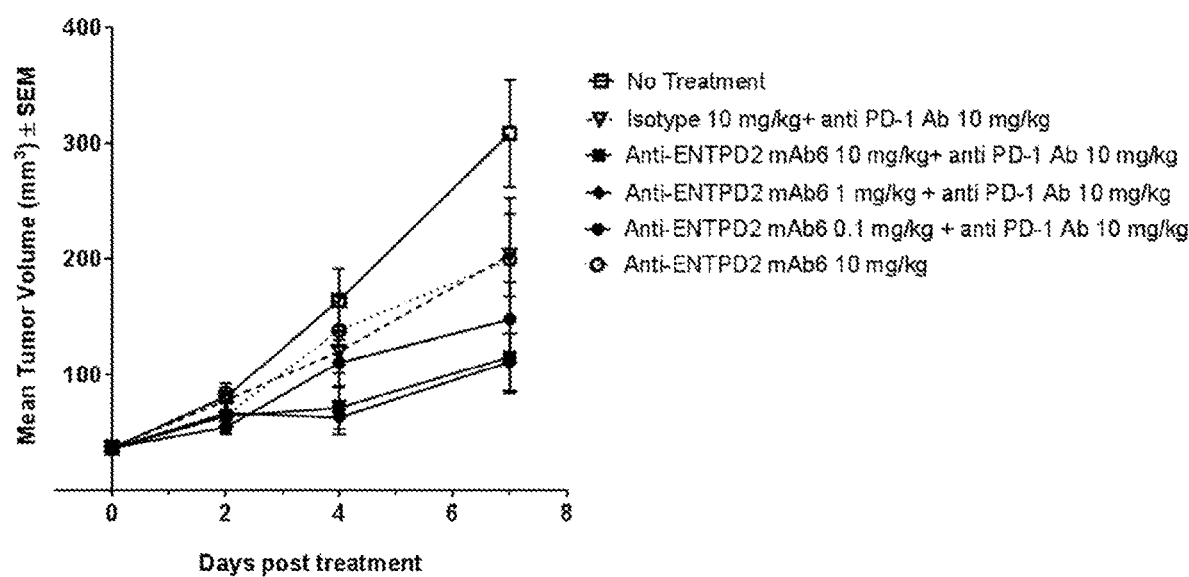

No significant anti-tumor efficacy was observed after treatment with anti-human ENTPD2 mAb1 or mAb6 as single agents or the combination of the non-specific isotype control and anti-PD-1 Ab. Combination regimen of anti-human ENTPD2 mAb1 with anti-PD-1 Ab (fixed dose of 10 mg/kg) demonstrated a dose dependent anti-tumor effect with ΔT/ΔC value of 18.4% (10 mg/kg), 35.7% (1 mg/kg) and 33.4% (0.1 mg/kg). Similarly combination regimen of anti-human ENTPD2 mAb6 with anti-PD-1 Ab (fixed dose of 10 mg/kg) also demonstrated a dose dependent anti-tumor effect with ΔT/ΔC value of 29.2% (10 mg/kg), 27.3% (1 mg/kg) and 41.0% (0.1 mg/kg) (Table 23 and FIGS. 12A-12B).

TABLE 23

Anti-human ENTPD2 Ab dose response efficacy in human ENTPD2 engineered B16LM3 clone B5 xenograft model on Day 7 of treatment.

| Treatment | Anti-human ENTPD2 mAb Dose, schedule | Anti-PD-1 Ab Dose, schedule | Tumor Response ΔT/ΔC (%) | Host Response | |
|---|---|---|---|---|---|
| | | | | Δ body weight (%) | Survival (alive/total) |
| No Treatment | None | None | | 0.1 | 8/8 |
| Isotype + anti-PD-1 Ab | 10 mg/kg dosed D 1 | 10 mg/kg dosed D 1 and D 5 | 61.2 | 0.0 | 8/8 |
| Anti-human ENTPD2 mAb1 + anti-PD-1 Ab | 10 mg/kg dosed D 1 | 10 mg/kg dosed D 1 and D 5 | 18.4** | −1.2 | 8/8 |
| Anti-human ENTPD2 mAb1 + anti-PD-1 Ab | 1 mg/kg dosed D 1 | 10 mg/kg dosed D 1 and D 5 | 35.7* | −2.9 | 8/8 |
| Anti-human ENTPD2 mAb1 + anti-PD-1 Ab | 0.1 mg/kg dosed D 1 | 10 mg/kg dosed D 1 and D 5 | 33.4* | −0.3 | 8/8 |
| Anti-human ENTPD2 mAb6 + anti-PD-1 Ab | 10 mg/kg dosed D 1 | 10 mg/kg dosed D 1 and D 5 | 29.2* | −1.9 | 8/8 |
| Anti-human ENTPD2 mAb6 + anti-PD-1 Ab | 1 mg/kg dosed D 1 | 10 mg/kg dosed D 1 and D 5 | 27.3* | −1.6 | 8/8 |
| Anti-human ENTPD2 mAb6 + anti-PD-1 Ab | 0.1 mg/kg dosed D 1 | 10 mg/kg dosed D 1 and D 5 | 41.0 | 0.2 | 8/8 |
| Anti-human ENTPD2 mAb1 | 10 mg/kg dosed D 1 | None | 71.7 | −0.2 | 8/8 |
| Anti-human ENTPD2 mAb6 | 10 mg/kg dosed D 1 | None | 60.0 | −0.1 | 8/8 |

The experiment was evaluated on treatment Day 7,
*p < 0.05
**p < 0.005 versus control No Treatment group (One-Way ANOVA/Tukey's Multiple Comparisons Test).
% ΔT/ΔC = 100 ΔT/ΔC where: ΔT = mean tumor volume of the drug treated group on D 7 of study − mean tumor volume of the drug treated group on initial day of dosing; ΔC = mean tumor volume of the control group on D 7 of study − mean tumor volume of the control group on initial day of dosing D 1. Δ body weight (%) = (Mean body weight D 28 − mean body weight D 1) *100/Mean body weight D 1 of treatment.

Example 11. Anti-Human ENTPD2 mAb Activity in the Human ENTPD2 Engineered B16LM3 Clone B5 Xenograft Model in C57BL/6 Mice In order to understand immediate impact of ENTPD2 blockade from immune pathway engagement perspective, plasma and B16LM3 clone B5 tumors (mean tumor volume ~170 mm$^3$) were collected from C57BL/6 mice 24 hr after treatment with anti-human ENTPD2 mAb1 or Isotype Control at 10 mg/kg. Anti-human ENTPD2 mAb1 is not mouse ENTPD2 cross-reactive, so any cytokine modulation in the periphery would be reflective of changes in tumor microenvironment.

Briefly, plasma was isolated via collection of blood into Microvette MV-H-300 Capillary Plasma Lithium Heparin Blood Collection tube (Sai Infusion technologies, Lake Villa, IL), that were spun down at 1000-2000×g for 10 min. Plasma samples were stored at −80° C. until use. Tumor samples were surgically excised and immediately frozen in liquid nitrogen. Tumor tissue was then homogenized in T-PER Tissue Protein Extraction Reagent (ThermoFisher, Waltham, MA) using the TissueLyser (Qiagen, Germany) instrument. Tumor lysate samples were spun down at 11,000 rpm for 15 min and supernatants were collected for protein concentration analysis using Pierce BCA Protein Assay Kit (ThermoFisher, Waltham, MA). 200 μg of protein or 25 μl of undiluted plasma was used for cytokine analysis using the V-PLEX Mouse Cytokine 29-Plex Kit (MSD, Rockville, MD) according to manufacturer's recommendations.

Figure 13A:
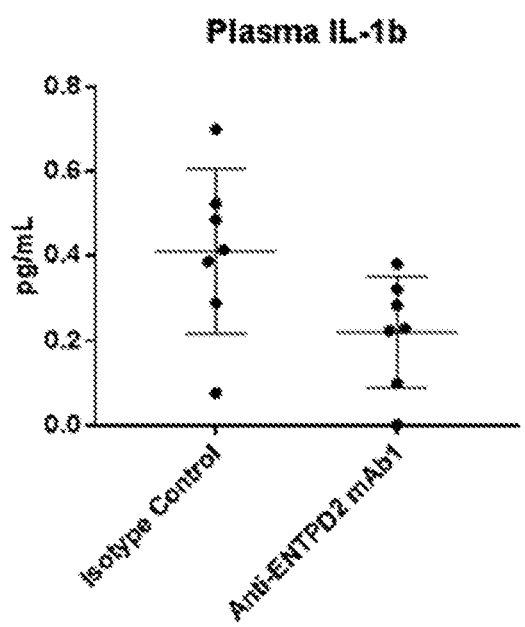
FIGS. 13A-13B are dot plots showing plasma IL-1b (FIG. 13A) and MCP-1 (FIG. 13B) levels after treatment with anti-human ENTPD2 mAb1 or an isotype control in the human ENTPD2 engineered B16LM3 clone B5 xenograft model in C57BL/6 mice.
Figure 13B:
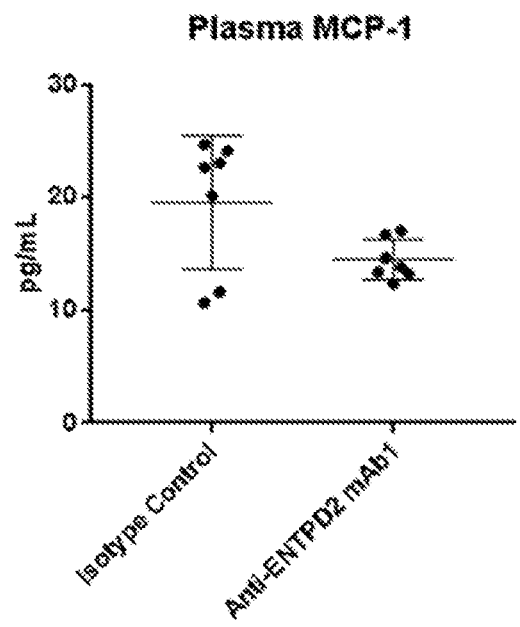
Figure 13C:
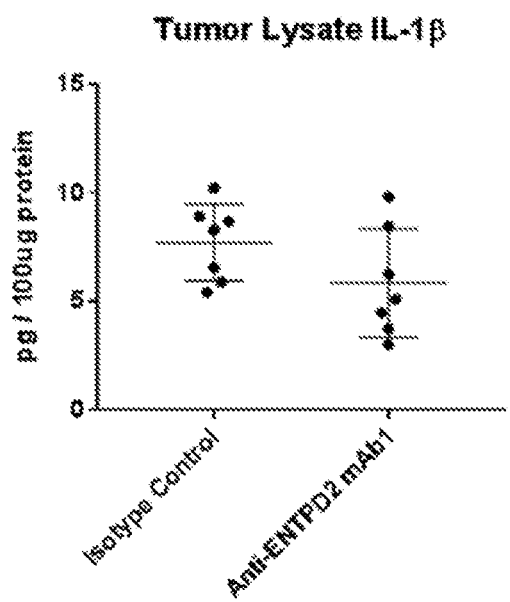
FIGS. 13C-13D are dot plots showing IL-1β (FIG. 13C) and MCP-1 (FIG. 13D) levels in tumor after treatment with anti-human ENTPD2 mAb1 or an isotype control in the human ENTPD2 engineered B16LM3 clone B5 xenograft model in C57BL/6 mice.
Figure 13D:
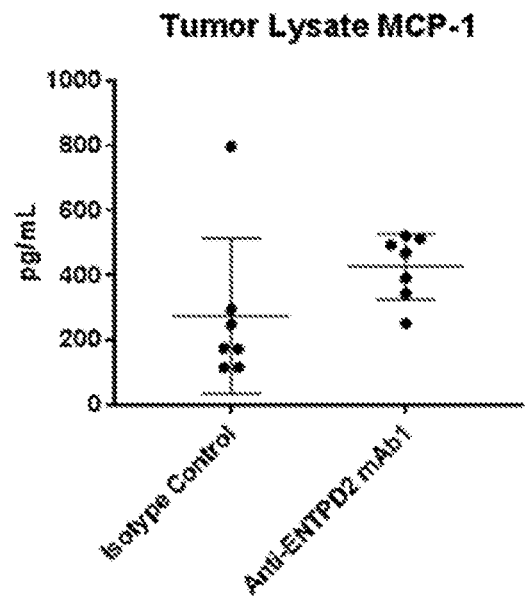

A significant decrease in plasma MCP1 (p<0.05 Unpaired T-Test), accompanied by an approximately 2-fold increase in MCP1 at the tumor site was observed with anti-human ENTPD2 mAb1 treatment (FIGS. 13B and 13D), potentially reflecting myeloid cell engagement and recruitment to the tumor site. In addition, an approximately 2-fold decrease of IL-1β was observed in plasma from anti-human ENTPD2 mAb1 treated animals (p=0.05 Unpaired T-Test) and a trend suggesting a parallel reduction at the tumor site (FIGS. 13A and 13C).

Example 12. Anti-Human ENTPD2 mAb Activity in Combination with A2AR Antagonist in the Human ENTPD2 Engineered B16LM3 Clone B5 Xenograft Model in C57BL/6 Mice Human ENTPD2-engineered B16LM3 clone B5 was established in female C57BL/6 mice by subcutaneous injection of 0.5×10$^6$ cells into the right flank of each mouse. Once tumors reached approximately 50 mm$^3$, mice were randomized according to tumor volume into treatment groups (n=8 per group). Mice received an intravenous (i.v.) treatment of either anti-ENTPD2 mAb1 at a final dose of 10/mg/kg or a non-specific human IgG1 isotype control 10 mg/kg on day 1 of study. NIR178 was administered per os (p.o.) for 4 days on and 3 days off, starting at the beginning of study at either 50 mg/kg or 200 mg/kg. All doses were adjusted to individual mouse body weights. The study was carried out for thirteen days post treatment initiation and tumor volumes were assessed every other day to assess efficacy. All test agents were tolerated on study and no overt clinical symptoms of toxicities or body weight loss were observed in any of the treatment groups (Table 27).

TABLE 27

In vivo efficacy of anti-human ENTPD2 Ab and A2AR antagonist in human ENTPD2 engineered B16LM3 clone B5 xenograft model on Day 13 of treatment.

| Treatment | Anti-human ENTPD2 or isotype mAb Dose, schedule | NIR178 or Vehicle Dose, schedule | Tumor Response ΔT/ΔC (%) | Host Response ΔBody weight (%) | Survival (alive/total) |
|---|---|---|---|---|---|
| No Treatment | None | None | | −2.2 | 6/8 |
| Vehicle + hIgG1 Isotype | 10 mg/kg, dosed D 1 | 4 d ON/ 3 d OFF | 96.9 | −2.0 | 6/8 |
| NIR178 + hIgG1 Isotype | 10 mg/kg, dosed D 1 | 50 mg/kg, 4 d ON/ 3 d OFF | 123.6 | −1.4 | 7/8 |
| NIR178 + hIgG1 Isotype | 10 mg/kg, dosed D 1 | 200 mg/kg, 4 d ON/ 3 d OFF | 93.3 | −2.5 | 6/8 |
| NIR178 + Anti-human ENTPD2 mAb1 | 10 mg/kg, dosed D 1 | 50 mg/kg, 4 d ON/ 3 d OFF | 61.6 | 1.3 | 8/8 |

The experiment was evaluated on treatment Day 13. % ΔT/ΔC = 100 ΔT/ΔC where: ΔT = mean tumor volume of the drug treated group on D 13 of study − mean tumor volume of the drug treated group on initial day of dosing; ΔC = mean tumor volume of the control group on D 13 of study − mean tumor volume of the control group on initial day of dosing D 1. Δ Body weight (%) = (Mean body weight D 28 − mean body weight D 1) *100/Mean body weight D 1 of treatment.

Figure 14:
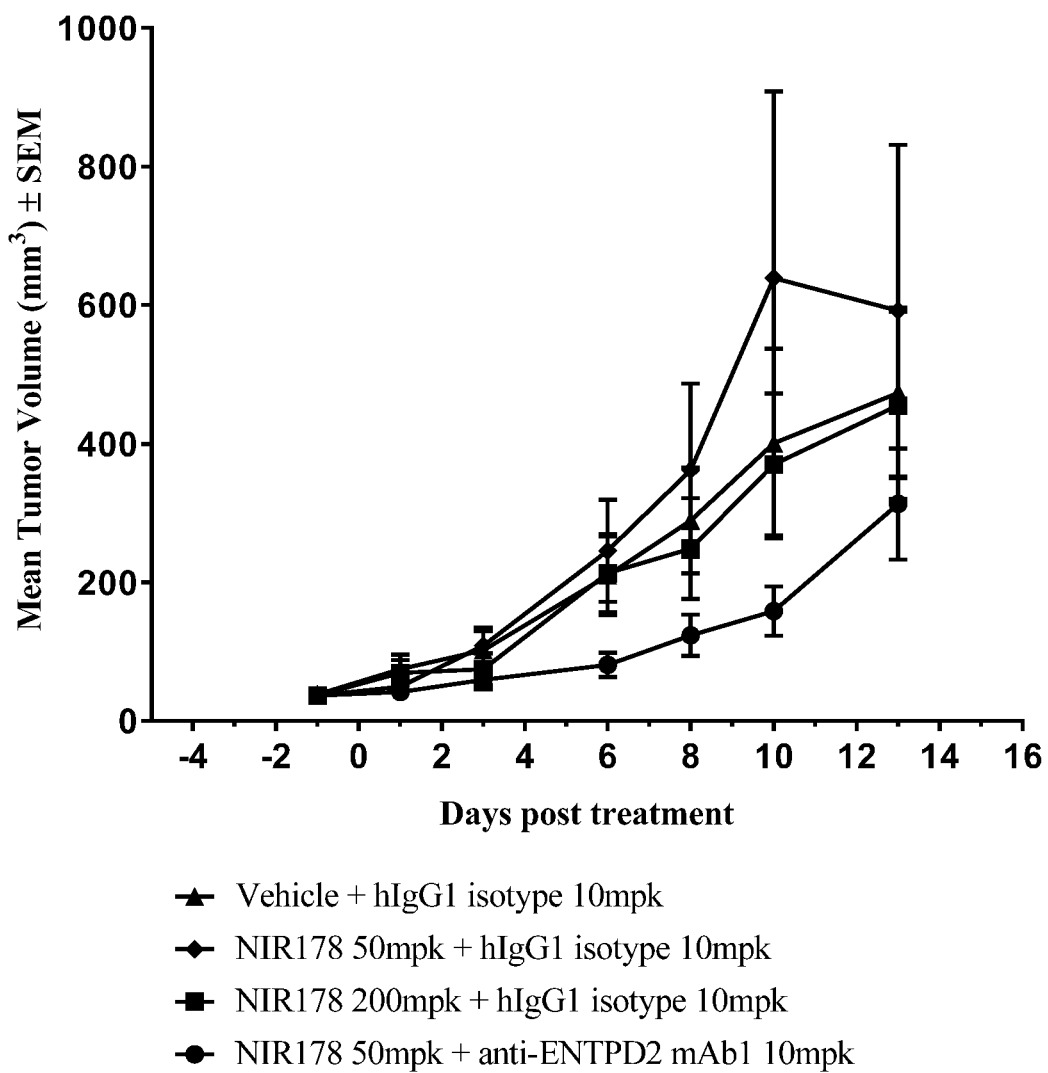
FIG. 14 is a graph showing in vivo efficacy of anti-ENTPD2 mAb1 in combination with A2AR antagonist NIR178 in the human ENTPD2 engineered B16LM3 xenograft model in C57BL/6 mice.

No significant anti-tumor efficacy was observed after treatment with the combination of the non-specific isotype control and the A2AR antagonist, NIR178, at either 50 or 200 mg/kg. The combination regimen of anti-ENTPD2 mAb1 (10 mg/kg) with NIR178 (50 mg/kg) demonstrated an anti-tumor effect with T/ΔC value of 61.6% (Table 27 and FIG. 14). These data suggest that there is enhanced anti-tumor efficacy when blocking multiple nodes in the adenosine pathway.

Example 13. Assessment of Anti-ENTPD2 Abs in the Biochemical and Cell-Based Functional Assays Biochemical and cell-based functional assays were developed in-house to understand functional impact of anti-ENTPD2 Abs against purified extracellular domain of ENTPD2 (residues 29-462), as well as against the fully intact protein in the context of the native cell-based conformation. ENTPD2 hydrolyzes ATP to ADP, which can subsequently be detected using the HTRF Transcreener ADP2 TR-FRET Red Assay (BellBrook Labs, Madison, WI) where ENTPD2-produced ADP would compete with the ADP Tracer for binding to the anti-ADP-Tb antibody. The resulting signal is inversely proportional to the concentration of ADP in the sample.

To evaluate activity of anti-ENTPD2 Abs in the ENTPD2 biochemical assay, anti-ENTPD2 Abs and recombinant ENTPD2 (residues 29-462) were diluted in reaction buffer (50 mM HEPES, pH 7.1, 10 mM $MgCl_2$, 0.01% BSA) to the desired concentration. 4 μL per well of the ENTPD2 solution and 2 μL per well of the Anti-ENTPD2 Ab solution were transferred into a ProxiPlate (PerkinElmer, Waltham, MA) and incubated for 30 min at room temperature. Reaction was then initiated via addition of 2 μl of ATP (final assay concentration of 1 μM), and the sample was incubated for 25 min at room temperature. Reaction was quenched with 200 mM EDTA/200 mM EGTA (5 μL per well) and detection reagents were added to wells (5 μL per well), with a final concentration of 4 nM ADP2 antibody and 4 nM ADP Tracer in well (BellBrooks Labs, Madison, WI). Plate was then incubated at room temperature for 60 min before measuring the HTRF signal.

To establish cell-based functional assays, human/cyno/mouse ENTPD2-engineered NIH/3T3 cells or RKO (ATCC, Manassa VA) colorectal cancer cells with endogenous ENTPD2 expression were plated overnight at 150, 200 and 250 cells per well for NIH/3T3 mouse, cyno and human ENTPD2 lines, respectively, or 1000 cells per well for RKO in 384-well tissue culture plate, in 30 μl per well (Perkin Elmer, Waltham, MA). The following day cells were pre-incubated with Anti-ENTPD2 Abs in dose response for 60 min at 37° C., 5% $CO_2$ (10 μl of 5× antibody dose per well), and subsequently stimulated with a final concentration of 10 μM ATP (Teknova, Hollister, CA) for 20 minutes at room temperature (10 μl of 5× (50 μM) ATP per well). Reactions were quenched with 40 mM EDTA/40 mM EGTA, 25 μl per well, and 15 μl of quenched media was transferred to low volume Proxiplates (PerkinElmer, Waltham, MA) for ADP detection. ADP production was detected with the Transcreener ADP2 TR-FRET Red Assay (BellBrook Labs, Madison, WI) with a final concentration of 4 nM ADP2 antibody and 13.4 nM of ADP Tracer in wells (4× solution was prepared and 5 μL of "Detection Reagent Mix" was added to the quenched conditioned media). Plates were incubated with detection reagents for 1 hour at room temperature prior to reading plates in HTRF mode.

HTRF signal (Emission at 620 nm and 665 nm) was assessed in both assays using the Envision plate reader in HTRF mode (Perkin Elmer, Waltham, MA). HTRF ratio was determined using the following formula: HTRF ratio=R=Emission at 665 nm/Emission at 620 nm×10,000. Subsequently % Residual Activity and % Inhibition were determined as follows:

$$\% \text{ Residual Activity} = \frac{(R - R_{0\%})}{(R_{100\%} - R_{0\%})} * 100;$$

-continued $$\% \text{ Inhibition} = 100 - \left[\frac{(R - R_{0\%})}{(R_{100\%} - R_{0\%})} * 100\right].$$

Where $R_{0\%}$ is the HTRF ratio of the negative control (0% enzyme activity), and $R_{100\%}$ is the HTRF ratio of the positive control (100% enzyme activity). Data were analyzed in Microsoft Excel and graphed using GraphPad's Prism 7.0 software and $IC_{50}$ values were obtained using non-linear regression, log (agonist) vs. response-variable slope (four parameters) analysis.

Figure 15:
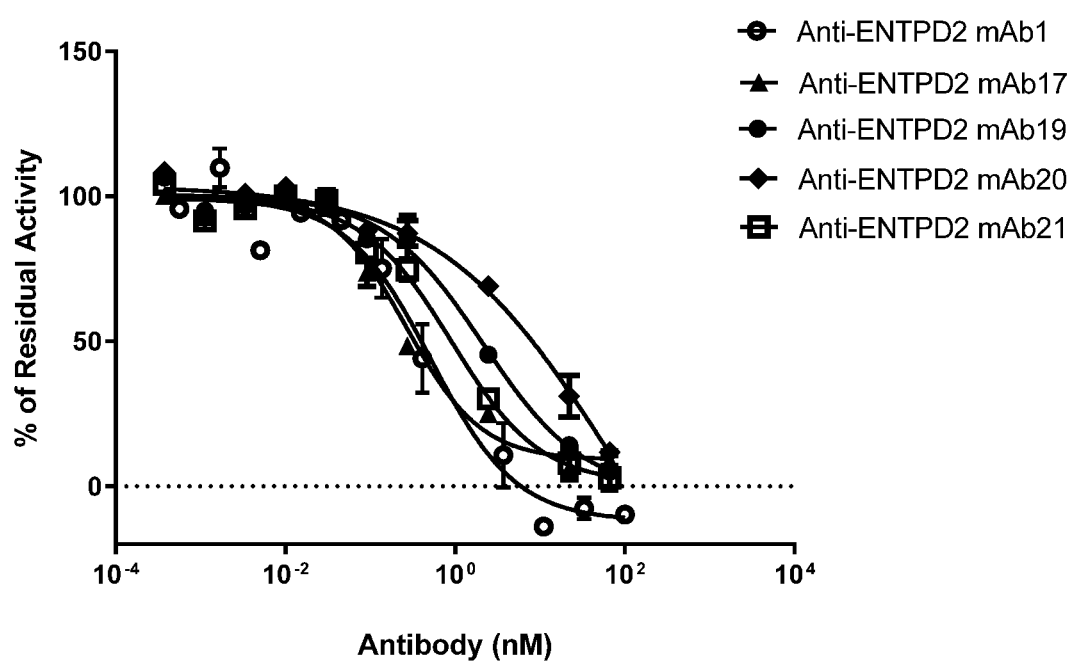
FIG. 15 is a graph showing representative activity of anti-ENTPD2 Abs in the biochemical human ENTPD2 functional assay. Anti-human ENTPD2 mAb1, mAb17, mAb19, and mAb21 potently inhibit the catalytic activity of the recombinant human ENTPD2.

Representative Activity of Anti-ENTPD2 Abs in the Biochemical Human ENTPD2 Functional Assay Anti-ENTPD2 Abs from the hybridoma and phage display campaigns were triaged for functional activity in the biochemical human ENTPD2 assay. Representative activity of Anti-ENTPD2 Abs and their $IC_{50}$s are shown in FIG. 15 and Table 28. A range of activities was observed for a number of Abs with some displaying very potent activity in the assay with sub-nanomolar $IC_{50}$ and complete target inhibition or others demonstrating much weaker activity and only partial enzyme inhibition (data not shown).

TABLE 28

In vitro activity profiles of Anti-ENTPD2 Abs in the human ENTPD2 biochemical functional assay

| Antibody | ENTPD2 Biochemical Assay at 1 uM ATP $IC_{50}$ (nM) |
|---|---|
| Anti-ENTPD2 mAb1 | 0.52 |
| Anti-ENTPD2 mAb16 | 77.33 |
| Anti-ENTPD2 mAb17 | 0.27 |
| Anti-ENTPD2 mAb19 | 4.09 |
| Anti-ENTPD2 mAb20 | 17.49 |
| Anti-ENTPD2 mAb21 | 0.87 |

Figure 16A:
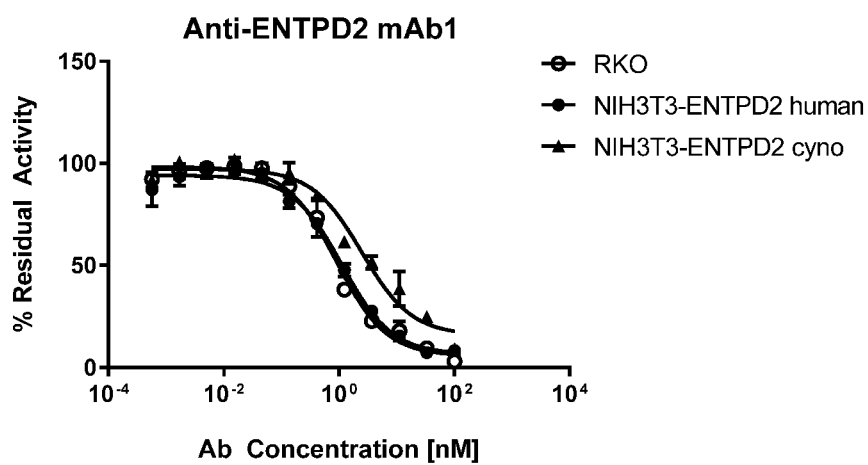
FIGS. 16A-16B depicts representative activity of anti-human ENTPD2 Abs in the human or cyno ENTPD2 NIH/3T3 or RKO cell-based functional assay.
Figure 16B:
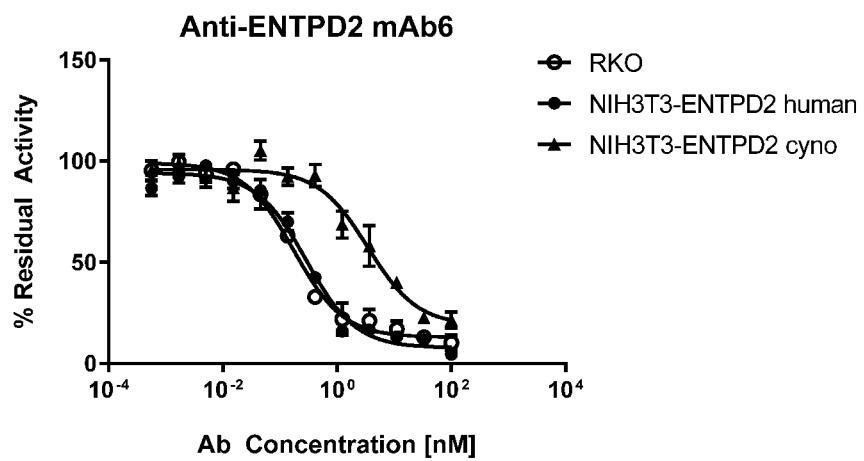

Activity of Anti-ENTPD2 Abs in the Cell-Based Human and Cyno ENTPD2 Functional Assays Initial profiling of Abs in the biochemical ENPTD2 assay identified a number of potent hits with strong inhibitory activity against the recombinant extracellular domain of ENTPD2, however differential behavior profiles were observed for a subset of Abs between the biochemical and cell-based functional assays, suggesting that conformational differences may exist between the purified recombinant protein and the native cell-based conformation (data not shown). In order to confirm potent activity of Abs against native ENTPD2, anti-ENTPD2 Abs were profiled for inhibitory activity using human- or cyno-ENTPD2 engineered NIH/3T3 cells or the RKO cell line with endogenous ENTPD2 expression. Summary of anti-ENTPD2 Abs activity profiles across the human or cyno ENTPD2 NIH/3T3 or RKO cell-based assays is captured in Table 29. Representative graphs depicting potent activity across all three functional assays for a subset of anti-ENTPD2 Abs are shown in FIG. 16.

TABLE 29

In vitro activity profiles of ENTPD2 selective Abs in the human or cyno ENTPD2 NIH/3T3 or RKO cell-based assays

| Antibody | Human ENTPD2 NIH/3T3 Assay | | RKO Assay | | Cyno ENTPD2 NIH/3T3 Assay | |
|---|---|---|---|---|---|---|
| | $IC_{50}$ (nM) | % inhibition | $IC_{50}$ (nM) | % inhibition | $IC_{50}$ (nM) | % inhibition |
| Anti-ENTPD2 mAb1 | 1.1 | 92 | 0.8 | 97 | 4.1 | 91 |
| Anti-ENTPD2 mAb2 | 1.4 | 98 | 0.8 | 86 | 2.7 | 84 |
| Anti-ENTPD2 mAb3 | 1.8 | 91 | 1.6 | 95 | 5.8 | 84 |
| Anti-ENTPD2 mAb4 | 0.2 | 87 | 0.2 | 74 | 2.2 | 75 |
| Anti-ENTPD2 mAb5 | 0.3 | 95 | 0.2 | 80 | 1.5 | 80 |
| Anti-ENTPD2 mAb6 | 0.3 | 95 | 0.2 | 90 | 3.3 | 73 |
| Anti-ENTPD2 mAb7 | 0.8 | 95 | 0.6 | 92 | 2.7 | 82 |
| Anti-ENTPD2 mAb8 | 0.1 | 97 | 0.2 | 95 | 0.9 | 96 |
| Anti-ENTPD2 mAb9 | 0.3 | 92 | 0.1 | 70 | 0.3 | 71 |
| Anti-ENTPD2 mAb10 | 0.4 | 88 | 0.2 | 77 | 0.5 | 86 |
| Anti-ENTPD2 mAb11 | 1.5 | 55 | | | | |
| Anti-ENTPD2 mAb12 | 26.6 | 68 | | | | |
| Anti-ENTPD2 mAb16 | >133 | 30 | | | >133 | 5 |
| Anti-ENTPD2 mAb17 | 0.6 | 98 | 0.5 | 96 | 1.0 | 91 |
| Anti-ENTPD2 mAb18 | 0.4 | 88 | | | 20 | 68 |

Figure 17:
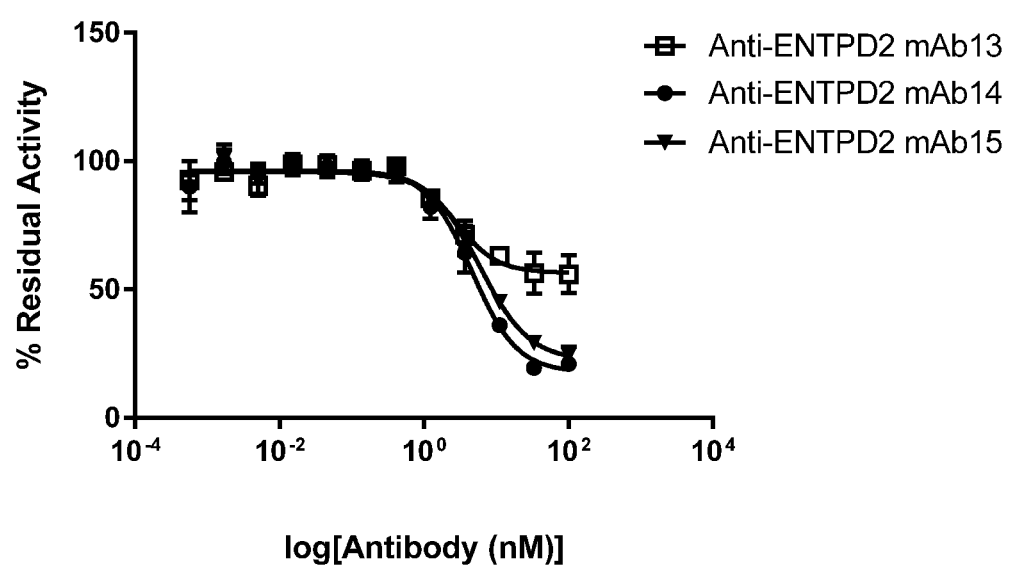
FIG. 17 depicts graph illustrating in vitro functional activity of anti-mouse ENTPD2 mAb13, mAb14, mAb15 in the mouse ENTPD2 NIH/3T3 cell-based functional assay.

Example 14. Structure Guided Engineering Identified More Potent Surrogate Anti-Mouse ENTPD2 Abs Anti-ENTPD2 mAb13 was identified as a mouse ENTPD2 selective Ab (FACS $EC_{50}$ 3-4 nM) with no binding to human or cyno ENTPD2. Activity of Anti-ENTPD2 mAb13 was assessed using the NIH3T3-mouse ENTPD2 engineered cell line, where Anti-ENTPD2 mAb13 displayed activity as a partial enzymatic inhibitor with a 2.8 nM $IC_{50}$ and maximum 44% target inhibition. Examination of the Anti-ENTPD2 mAb13 Fab/mENTPD2 complex crystal structure and superposition of ATP-substrate analog from PDB code 3CJA rENTPD2 within the mENTPD2 active site, revealed T30 in CDR1 of the Anti-ENTPD2 mAb13 HC as an optimal site where substitution of larger amino acid would be predicted to sterically block ATP binding A subset of constructs with substitutions at the T30 position of Anti-ENTPD2 mAb13 CDR1 were engineered, including Anti-ENTPD2 mAb14 and mAb15. Evaluation of engineered variants of Anti-ENTPD2 mAb14 and mAb15 in the mouse ENTPD2 NIH/3T3 cell-based functional assay, demonstrated significantly improved target inhibition as compared to the parental Anti-ENTPD2 mAb13, reaching approximately 76-79% mouse ENTPD2 inhibition with a 5-6 nM IC50 (Table 30, FIG. 17).

TABLE 30

In vitro activity profiles of mouse ENTPD2 selective
Abs in the mouse ENTPD2 cell-based functional assay

| Antibody | ENTPD2 Functional Assay IC$_{50}$ (nM) | % Inhibition at 100 nM (±Std Err) |
|---|---|---|
| Anti-ENTPD2 mAb13 | 2.8 | 44 ± 7.3 |
| Anti-ENTPD2 mAb14 | 4.6 | 79 ± 2.2 |
| Anti-ENTPD2 mAb15 | 5.9 | 76 ± 3.4 |

Unless defined otherwise, the technical and scientific terms used herein have the same meaning as they usually understood by a specialist familiar with the field to which the disclosure belongs.

Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein. Unless indicated otherwise, each of the references cited herein is incorporated in its entirety by reference.

Claims to the invention are non-limiting and are provided below.

Although particular aspects and claims have been disclosed herein in detail, this has been done by way of example for purposes of illustration only, and is not intended to be limiting with respect to the scope of the appended claims, or the scope of subject matter of claims of any corresponding future application. In particular, it is contemplated by the inventors that various substitutions, alterations, and modifications may be made to the disclosure without departing from the spirit and scope of the disclosure as defined by the claims. The choice of nucleic acid starting material, clone of interest, or library type is believed to be a matter of routine for a person of ordinary skill in the art with knowledge of the aspects described herein. Other aspects, advantages, and modifications considered to be within the scope of the following claims. Those skilled in the art will recognize or be able to ascertain, using no more than routine experimentation, many equivalents of the specific aspects of the invention described herein. Such equivalents are intended to be encompassed by the following claims. Redrafting of claim scope in later filed corresponding applications may be due to limitations by the patent laws of various countries and should not be interpreted as giving up subject matter of the claims.

SEQUENCE LISTING (1015 sequences)

SEQ ID NO: 1 - protein, 5 aa, Artificial Sequence
  source: /note="Description of Artificial Sequence: Synthetic peptide"
DYNMD

SEQ ID NO: 2 - protein, 17 aa, Artificial Sequence
  source: /note="Description of Artificial Sequence: Synthetic peptide"
DINPKYDISTYNQQFKG

SEQ ID NO: 3 - protein, 16 aa, Artificial Sequence
  source: /note="Description of Artificial Sequence: Synthetic peptide"
RGFFLYYGINYYYFDV

SEQ ID NO: 4 - protein, 7 aa, Artificial Sequence
  source: /note="Description of Artificial Sequence: Synthetic peptide"
GYTFTDY

SEQ ID NO: 5 - protein, 6 aa, Artificial Sequence
  source: /note="Description of Artificial Sequence: Synthetic peptide"
NPKYDI

SEQ ID NO: 6 - protein, 10 aa, Artificial Sequence
  source: /note="Description of Artificial Sequence: Synthetic peptide"
GYTFTDYNMD

SEQ ID NO: 7 - protein, 8 aa, Artificial Sequence
  source: /note="Description of Artificial Sequence: Synthetic peptide"
GYTFTDYN

SEQ ID NO: 8 - protein, 8 aa, Artificial Sequence
  source: /note="Description of Artificial Sequence: Synthetic peptide"
INPKYDIS

SEQ ID NO: 9 - protein, 18 aa, Artificial Sequence
  source: /note="Description of Artificial Sequence: Synthetic peptide"
ARRGFFLYYGINYYYFDV

SEQ ID NO: 10 - protein, 125 aa, Artificial Sequence
  source: /note="Description of Artificial Sequence: Synthetic polypeptide"
EVQLVQSGAEVKKPGESLKISCKASGYTFTDYNMDWVRQMPGKGLEWMGDINPKYDISTYNQQFKGQVTISADKSIRTAYLQWSSLKASDTAMYYCARRGFFLYYGINYYYFDVWGQGTLVTVSS

SEQ ID NO: 11 - DNA, 375 bp, Artificial Sequence
  source: /note="Description of Artificial Sequence: Synthetic polynucleotide"
gaagtgcagctggtgcagtctggcgccgaagtgaagaagcctggcgagtccctgaagatctcctgcaaggcctccggctacaccttcaccgactacaacatggactgggtgcgacagatgcccggcaagggcctggaatggatgggcgacatcaaccctaagtacgacatctccacctacaaccagcagttcaagggccaagtgaccatctccgccgacaagtccatccggaccgcctacctgcagtggtcctccctgaaggcctctgacaccgccatgtactactgcgccagacggggcttcttcctgtactacggcatcaactactactacttcgacgtgtggggccagggcaccctcgtgacagtgtcatct

SEQ ID NO: 12 - protein, 455 aa, Artificial Sequence
  source: /note="Description of Artificial Sequence: Synthetic polypeptide"
EVQLVQSGAEVKKPGESLKISCKASGYTFTDYNMDWVRQMPGKGLEWMGDINPKYDISTYNQQFKGQVTISADKSIRTAYLQWSSLKASDTAMYYCARRGFFLYYGINYYYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 13 - DNA, 1365 bp, Artificial Sequence
  source: /note="Description of Artificial Sequence: Synthetic polynucleotide"
gaagtgcagctggtgcagtctggcgccgaagtgaagaagcctggcgagtccctgaagatctcctgcaaggcctccggctacaccttcaccgactacaacatggactgggtgcgacagatgcccggcaagggcctggaatggatgggcgacatcaaccctaagtacgacatctccacctacaaccagcagttcaagggccaagtgaccatctccgccgacaagtccatccggaccgcctacctgcagtggtcctccctgaaggcctctgacaccgccatgtactactgcgccagacggggcttcttcctgtactacggcatcaactactactacttcgacgtgtggggccagggcaccctcgtgacagtgtcatctgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 14 - protein, 10 aa, Artificial Sequence
  source: /note="Description of Artificial Sequence: Synthetic peptide"
SASSSVSYIH

SEQ ID NO: 15 - protein, 7 aa, Artificial Sequence
  source: /note="Description of Artificial Sequence: Synthetic peptide"
STSNLAS

SEQ ID NO: 16 - protein, 9 aa, Artificial Sequence
  source: /note="Description of Artificial Sequence: Synthetic peptide"
HQWSSYPWT

SEQ ID NO: 17 - protein, 6 aa, Artificial Sequence
  source: /note="Description of Artificial Sequence: Synthetic peptide"
SSSVSY

SEQ ID NO: 18 - protein, 3 aa, Artificial Sequence
  source: /note="Description of Artificial Sequence: Synthetic peptide"
STS

SEQ ID NO: 19 - protein, 6 aa, Artificial Sequence
  source: /note="Description of Artificial Sequence: Synthetic peptide"
WSSYPW

SEQ ID NO: 20 - protein, 5 aa, Artificial Sequence
  source: /note="Description of Artificial Sequence: Synthetic peptide"
SSVSY

SEQ ID NO: 21 - protein, 106 aa, Artificial Sequence
  source: /note="Description of Artificial Sequence: Synthetic polypeptide"
DIQLTQSPSSLSASVGDRVTITCSASSSVSYIHWFQQKPGKAPKLLIYSTSNLASGVPSRFSGSGSGTFFTLTISSLQPEDFATYFCHQWSSYPWTFGQGTKVEIK

SEQ ID NO: 22 - DNA, 318 bp, Artificial Sequence
  source: /note="Description of Artificial Sequence: Synthetic polynucleotide"
gatatccagctgacccagtccccttccagcctgtctgcctctgtgggcgacagagtgacaattacctgctccgcctcctcctccgtgtcctacatccactggttccagcagaagcccggcaaggcccccaagctgctgatctactccacctccaacctggcctccggcgtgccctctagattctccggctctggctctggcaccttttttaccctgaccatctccagcctgcagcccgaggacttcgccacctacttttgccaccagtggtccagctacccctggacctttggccagggcaccaaggtggaaatcaag

SEQ ID NO: 23 - protein, 213 aa, Artificial Sequence
  source: /note="Description of Artificial Sequence: Synthetic polypeptide"
DIQLTQSPSSLSASVGDRVTITCSASSSVSYIHWFQQKPGKAPKLLIYSTSNLASGVPSRFSGSGSGTFFTLTISSLQPEDFATYFCHQWSSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - DNA, 639 bp, Artificial Sequence
  source: /note="Description of Artificial Sequence: Synthetic polynucleotide"
gatatccagctgacccagtccccttccagcctgtctgcctctgtgggcgacagagtgacaattacctgctccgcctcctcctccgtgtcctacatccactggttccagcagaagcccggcaaggcccccaagctgctgatctactccacctccaacctggcctccggcgtgccctctagattctccggctctggctctggcaccttttttaccctgaccatctccagcctgcagcccgaggacttcgccacctacttttgccaccagtggtccagctacccctggacctttggccagggcaccaaggtggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 25 - protein, 125 aa, Artificial Sequence
  source: /note="Description of Artificial Sequence: Synthetic polypeptide"
QVQLVQSGAEVVKPGASVKISCKASGYTFTDYNMDWVKQAPGQRLEWIGDINPKYDISTYNQQFKGKATITVDKSASTAYMELSSLRSEDTAVYYCARRGFFLYYGINYYYFDVWGQGTLVTVSS

SEQ ID NO: 26 - DNA, 375 bp, Artificial Sequence
  source: /note="Description of Artificial Sequence: Synthetic polynucleotide"
caggtgcagctggtgcagtctggcgccgaggtggtgaaacctggcgcctccgtgaagatctcctgcaaggcctccggctacaccttcaccgactacaacatggactgggtgaaacaggcccctggccagcggctggaatggatcggcgacatcaaccctaagtacgacatctccacctacaaccagcagttcaagggcaaggccaccatcaccgtggacaagtccgcctccaccgcctacatggaactgtcctccctgcggagcgaggacaccgccgtgtactactgcgccagacggggcttcttcctgtactacggcatcaactactactacttcgacgtgtggggccagggcaccctggtgacagtgtcctcc

SEQ ID NO: 27 - protein, 455 aa, Artificial Sequence
  source: /note="Description of Artificial Sequence: Synthetic polypeptide"
QVQLVQSGAEVVKPGASVKISCKASGYTFTDYNMDWVKQAPGQRLEWIGDINPKYDISTYNQQFKGKATITVDKSASTAYMELSSLRSEDTAVYYCARRGFFLYYGINYYYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 28 - DNA, 1365 bp, Artificial Sequence
  source: /note="Description of Artificial Sequence: Synthetic polynucleotide"
caggtgcagctggtgcagtctggcgccgaggtggtgaaacctggcgcctccgtgaagatctcctgcaaggcctccggctacaccttcaccgactacaacatggactgggtgaaacaggcccctggccagcggctggaatggatcggcgacatcaaccctaagtacgacatctccacctacaaccagcagttcaagggcaaggccaccatcaccgtggacaagtccgcctccaccgcctacatggaactgtcctccctgcggagcgaggacaccgccgtgtactactgcgccagacggggcttcttcctgtactacggcatcaactactactacttcgacgtgtggggccagggcaccctggtgacagtgtcctccgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 29 - protein, 106 aa, Artificial Sequence
  source: /note="Description of Artificial Sequence: Synthetic polypeptide"
EIVLTQSPATLSASPGERITLSCSASSSVSYIHWYQQKPGQAPRLLIYSTSNLASGIPARFSGSGSGTFYTLTISSVEPEDAAVYYCHQWSSYPWTFGGGTKLEIK

SEQ ID NO: 30 - DNA, 318 bp, Artificial Sequence
  source: /note="Description of Artificial Sequence: Synthetic polynucleotide"
gagatcgtgctgacccagtcccctgccaccctgtctgccagccctggcgagcggatcaccctgtcctgctccgcctcctcctccgtgtcctacatccactggtatcagcagaagcccggccaggcccctcggctgctgatctactccacctccaacctggcctccggcatccctgccagattctccggctctggctccggcaccttttacaccctgaccatctccagcgtggaacccgaggacgccgccgtgtactactgccaccagtggtccagctacccctggaccttcggcggaggcaccaagctggaaatcaag

SEQ ID NO: 31 - protein, 213 aa, Artificial Sequence
  source: /note="Description of Artificial Sequence: Synthetic polypeptide"
EIVLTQSPATLSASPGERITLSCSASSSVSYIHWYQQKPGQAPRLLIYSTSNLASGIPARFSGSGSGTFYTLTISSVEPEDAAVYYCHQWSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - DNA, 639 bp, Artificial Sequence
  source: /note="Description of Artificial Sequence: Synthetic polynucleotide"
gagatcgtgctgacccagtcccctgccaccctgtctgccagccctggcgagcggatcaccctgtcctgctccgcctcctcctccgtgtcctacatccactggtatcagcagaagcccggccaggcccctcggctgctgatctactccacctccaacctggcctccggcatccctgccagattctccggctctggctccggcaccttttacaccctgaccatctccagcgtggaacccgaggacgccgccgtgtactactgccaccagtggtccagctacccctggaccttcggcggaggcaccaagctggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 33 - protein, 125 aa, Artificial Sequence
  source: /note="Description of Artificial Sequence: Synthetic polypeptide"
QVQLVQSGAEVVKPGASVKISCKASGYTFTDYNMDWVKQAPGQRLEWIGDINPKYDISTYNQQFKGKATITVDTSASTAYMELSSLRSEDTAVYYCARRGFFLYYGINYYYFDVWGQGTLVTVSS

SEQ ID NO: 34 - DNA, 375 bp, Artificial Sequence
  source: /note="Description of Artificial Sequence: Synthetic polynucleotide"
caggtgcagctggtgcagtctggcgccgaggtggtgaaacctggcgcctccgtgaagatctcctgcaaggcctccggctacaccttcaccgactacaacatggactgggtgaaacaggcccctggccagcggctggaatggatcggcgacatcaaccctaagtacgacatctccacctacaaccagcagttcaagggcaaggccaccatcaccgtggacacctccgcctccaccgcctacatggaactgtcctccctgcggagcgaggacaccgccgtgtactactgcgccagacggggcttcttcctgtactacggcatcaactactactacttcgacgtgtggggccagggcaccctggtgacagtgtcctcc

SEQ ID NO: 35 - protein, 455 aa, Artificial Sequence
  source: /note="Description of Artificial Sequence: Synthetic polypeptide"
QVQLVQSGAEVVKPGASVKISCKASGYTFTDYNMDWVKQAPGQRLEWIGDINPKYDISTYNQQFKGKATITVDTSASTAYMELSSLRSEDTAVYYCARRGFFLYYGINYYYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - DNA, 1365 bp, Artificial Sequence
  source: /note="Description of Artificial Sequence: Synthetic polynucleotide"
caggtgcagctggtgcagtctggcgccgaggtggtgaaacctggcgcctccgtgaagatctcctgcaaggcctccggctacaccttcaccgactacaacatggactgggtgaaacaggcccctggccagcggctggaatggatcggcgacatcaaccctaagtacgacatctccacctacaaccagcagttcaagggcaaggccaccatcaccgtggacacctccgcctccaccgcctacatggaactgtcctccctgcggagcgaggacaccgccgtgtactactgcgccagacggggcttcttcctgtactacggcatcaactactactacttcgacgtgtggggccagggcaccctggtgacagtgtcctccgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 37 - protein, 6 aa, Artificial Sequence
  source: /note="Description of Artificial Sequence: Synthetic peptide"
SGYYWN

SEQ ID NO: 38 - protein, 16 aa, Artificial Sequence
  source: /note="Description of Artificial Sequence: Synthetic peptide"
YISYDADNNYNPSLKN

SEQ ID NO: 39 - protein, 20 aa, Artificial Sequence
  source: /note="Description of Artificial Sequence: Synthetic peptide"
GYYRYGLGSYRGSYYYVMDY

SEQ ID NO: 40 - protein, 8 aa, Artificial Sequence
  source: /note="Description of Artificial Sequence: Synthetic peptide"
GYSITSGY

SEQ ID NO: 41 - protein, 5 aa, Artificial Sequence
  source: /note="Description of Artificial Sequence: Synthetic peptide"
SYDAD

SEQ ID NO: 42 - protein, 11 aa, Artificial Sequence
  source: /note="Description of Artificial Sequence: Synthetic peptide"
GYSITSGYYWN

SEQ ID NO: 43 - protein, 9 aa, Artificial Sequence
  source: /note="Description of Artificial Sequence: Synthetic peptide"
GYSITSGYY

SEQ ID NO: 44 - protein, 7 aa, Artificial Sequence
  source: /note="Description of Artificial Sequence: Synthetic peptide"
ISYDADN

SEQ ID NO: 45 - protein, 22 aa, Artificial Sequence
  source: /note="Description of Artificial Sequence: Synthetic peptide"
AGGYYRYGLGSYRGSYYYVMDY

SEQ ID NO: 46 - protein, 129 aa, Artificial Sequence
  source: /note="Description of Artificial Sequence: Synthetic polypeptide"
QIQLQESGPGLVKPSQTLSLTCTVSGYSITSGYYWNWIRQHPGKGLEWIGYISYDADNNYNPSLKNRVTISRDTSKNQFSLKLSSVTAADTAVYYCAGGYYRYGLGSYRGSYYYVMDYWGQGTTVTVSS

SEQ ID NO: 47 - DNA, 387 bp, Artificial Sequence
  source: /note="Description of Artificial Sequence: Synthetic polynucleotide"
cagatccagctgcaggaatctggccctggcctggtgaaaccctcccagaccctgtccctgacctgcaccgtgtccggctactccatcacctccggctactactggaactggatccggcagcaccccggcaagggcctggaatggatcggctacatctcctacgacgctgacaacaactacaaccccagcctgaagaacagagtgaccatctcccgggacacctccaagaaccagttctccctgaagctgtcctccgtgaccgccgctgacaccgccgtgtactactgcgctggcggctactacagatacggcctgggctcctaccggggctcctactactacgtgatggactactggggccagggcaccaccgtgaccgtgtcctct

SEQ ID NO: 48 - protein, 459 aa, Artificial Sequence
  source: /note="Description of Artificial Sequence: Synthetic polypeptide"
QIQLQESGPGLVKPSQTLSLTCTVSGYSITSGYYWNWIRQHPGKGLEWIGYISYDADNNYNPSLKNRVTISRDTSKNQFSLKLSSVTAADTAVYYCAGGYYRYGLGSYRGSYYYVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - DNA, 1377 bp, Artificial Sequence
  source: /note="Description of Artificial Sequence: Synthetic polynucleotide"
cagatccagctgcaggaatctggccctggcctggtgaaaccctcccagaccctgtccctgacctgcaccgtgtccggctactccatcacctccggctactactggaactggatccggcagcaccccggcaagggcctggaatggatcggctacatctcctacgacgctgacaacaactacaaccccagcctgaagaacagagtgaccatctcccgggacacctccaagaaccagttctccctgaagctgtcctccgtgaccgccgctgacaccgccgtgtactactgcgctggcggctactacagatacggcctgggctcctaccggggctcctactactacgtgatggactactggggccagggcaccaccgtgaccgtgtcctctgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 50 - protein, 15 aa, Artificial Sequence
  source: /note="Description of Artificial Sequence: Synthetic peptide"
KASQSVDYEGHSYMN

SEQ ID NO: 51 - protein, 7 aa, Artificial Sequence
  source: /note="Description of Artificial Sequence: Synthetic peptide"
AASNLES

SEQ ID NO: 52 - protein, 9 aa, Artificial Sequence
  source: /note="Description of Artificial Sequence: Synthetic peptide"
QQSNEDPPT

SEQ ID NO: 53 - protein, 11 aa, Artificial Sequence
  source: /note="Description of Artificial Sequence: Synthetic peptide"
SQSVDYEGHSY

SEQ ID NO: 54 - protein, 3 aa, Artificial Sequence
  source: /note="Description of Artificial Sequence: Synthetic peptide"
AAS

SEQ ID NO: 55 - protein, 6 aa, Artificial Sequence
  source: /note="Description of Artificial Sequence: Synthetic peptide"
SNEDPP

SEQ ID NO: 56 - protein, 10 aa, Artificial Sequence
  source: /note="Description of Artificial Sequence: Synthetic peptide"
QSVDYEGHSY

SEQ ID NO: 57 - protein, 111 aa, Artificial Sequence
  source: /note="Description of Artificial Sequence: Synthetic polypeptide"
ETVLTQSPATLSVSPGERATISCKASQSVDYEGHSYMNWYQQKPGQAPRLLIYAASNLESGIPARFSGSGSGTDFTLTISSVEPEDAATYYCQQSNEDPPTFGGGTKLEIK

SEQ ID NO: 58 - DNA, 333 bp, Artificial Sequence
  source: /note="Description of Artificial Sequence: Synthetic polynucleotide"
gagacagtgctgacccagtcccctgccaccctgtccgtgtctcccggcgagagagccaccatcagctgcaaggcctcccagtccgtggactacgaaggccattcctacatgaactggtatcagcagaagcccggccaggcccctcggctgctgatctacgccgcctccaacctggaatccggcatccctgcccggttctccggctctggctctggcaccgacttcaccctgaccatctccagcgtggaacccgaggacgccgccacctactactgccagcagtccaacgaggacccccccaccttcggcggaggcaccaagctggaaatcaag

SEQ ID NO: 59 - protein, 218 aa, Artificial Sequence
  source: /note="Description of Artificial Sequence: Synthetic polypeptide"
ETVLTQSPATLSVSPGERATISCKASQSVDYEGHSYMNWYQQKPGQAPRLLIYAASNLESGIPARFSGSGSGTDFTLTISSVEPEDAATYYCQQSNEDPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 60 - DNA, 654 bp, Artificial Sequence
  source: /note="Description of Artificial Sequence: Synthetic polynucleotide"
gagacagtgctgacccagtcccctgccaccctgtccgtgtctcccggcgagagagccaccatcagctgcaaggcctcccagtccgtggactacgaaggccattcctacatgaactggtatcagcagaagcccggccaggcccctcggctgctgatctacgccgcctccaacctggaatccggcatccctgcccggttctccggctctggctctggcaccgacttcaccctgaccatctccagcgtggaacccgaggacgccgccacctactactgccagcagtccaacgaggacccccccaccttcggcggaggcaccaagctggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 61 - protein, 15 aa, Artificial Sequence
  source: /note="Description of Artificial Sequence: Synthetic peptide"
KASQSVDYDGNSYMN

SEQ ID NO: 62 - protein, 11 aa, Artificial Sequence
  source: /note="Description of Artificial Sequence: Synthetic peptide"
SQSVDYDGNSY

SEQ ID NO: 63 - protein, 10 aa, Artificial Sequence
  source: /note="Description of Artificial Sequence: Synthetic peptide"
QSVDYDGNSY

SEQ ID NO: 64 - protein, 111 aa, Artificial Sequence
  source: /note="Description of Artificial Sequence: Synthetic polypeptide"
ETVLTQSPATLSVSPGERATISCKASQSVDYDGNSYMNWYQQKPGQAPRLLIYAASNLESGIPARFSGSGSGTDFTLTISSVEPEDAATYYCQQSNEDPPTFGGGTKLEIK

SEQ ID NO: 65 - DNA, 333 bp, Artificial Sequence
  source: /note="Description of Artificial Sequence: Synthetic polynucleotide"
gagacagtgctgacccagtcccctgccaccctgtccgtgtctcccggcgagagagccaccatcagctgcaaggcctcccagtccgtggactacgacggcaactcctacatgaactggtatcagcagaagcccggccaggcccctcggctgctgatctacgccgcctccaacctggaatccggcatccctgcccggttctccggctctggctctggcaccgacttcaccctgaccatctccagcgtggaacccgaggacgccgccacctactactgccagcagtccaacgaggacccccccaccttcggcggaggcaccaagctggaaatcaag

SEQ ID NO: 66 - protein, 218 aa, Artificial Sequence
  source: /note="Description of Artificial Sequence: Synthetic polypeptide"
ETVLTQSPATLSVSPGERATISCKASQSVDYDGNSYMNWYQQKPGQAPRLLIYAASNLESGIPARFSGSGSGTDFTLTISSVEPEDAATYYCQQSNEDPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - DNA, 654 bp, Artificial Sequence
  source: /note="Description of Artificial Sequence: Synthetic polynucleotide"
gagacagtgctgacccagtcccctgccaccctgtccgtgtctcccggcgagagagccaccatcagctgcaaggcctcccagtccgtggactacgacggcaactcctacatgaactggtatcagcagaagcccggccaggcccctcggctgctgatctacgccgcctccaacctggaatccggcatccctgcccggttctccggctctggctctggcaccgacttcaccctgaccatctccagcgtggaacccgaggacgccgccacctactactgccagcagtccaacgaggacccccccaccttcggcggaggcaccaagctggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 68 - protein, 20 aa, Artificial Sequence
  source: /note="Description of Artificial Sequence: Synthetic peptide"
GYYRYGLGSYSGSYYYVMDY

SEQ ID NO: 69 - protein, 22 aa, Artificial Sequence
  source: /note="Description of Artificial Sequence: Synthetic peptide"
AGGYYRYGLGSYSGSYYYVMDY

SEQ ID NO: 70 - protein, 129 aa, Artificial Sequence
  source: /note="Description of Artificial Sequence: Synthetic polypeptide"
QVQLQESGPGLVKPSQTLSLTCTVSGYSITSGYYWNWIRQHPGKGLEWMGYISYDADNNYNPSLKNRITISRDTSKNQFSLKLSSVTAADTAVYYCAGGYYRYGLGSYSGSYYYVMDYWGQGTTVTVSS

SEQ ID NO: 71 - DNA, 387 bp, Artificial Sequence
  source: /note="Description of Artificial Sequence: Synthetic polynucleotide"
caggtgcagctgcaggaatctggccctggcctggtgaaaccctcccagaccctgtccctgacctgcaccgtgtccggctactccatcacctccggctactactggaactggatccggcagcaccccggcaagggcctggaatggatgggctacatctcctacgacgctgacaacaactacaaccccagcctgaagaacagaatcaccatctcccgggacacctccaagaaccagttctccctgaagctgtcctccgtgaccgccgctgacaccgccgtgtactactgcgctggcggctactacagatacggcctgggctcctactccggctcctactactacgtgatggactactggggccagggcaccaccgtgaccgtgtcctct

SEQ ID NO: 72 - protein, 459 aa, Artificial Sequence
  source: /note="Description of Artificial Sequence: Synthetic polypeptide"
QVQLQESGPGLVKPSQTLSLTCTVSGYSITSGYYWNWIRQHPGKGLEWMGYISYDADNNYNPSLKNRITISRDTSKNQFSLKLSSVTAADTAVYYCAGGYYRYGLGSYSGSYYYVMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - DNA, 1377 bp, Artificial Sequence
  source: /note="Description of Artificial Sequence: Synthetic polynucleotide"
caggtgcagctgcaggaatctggccctggcctggtgaaaccctcccagaccctgtccctgacctgcaccgtgtccggctactccatcacctccggctactactggaactggatccggcagcaccccggcaagggcctggaatggatgggctacatctcctacgacgctgacaacaactacaaccccagcctgaagaacagaatcaccatctcccgggacacctccaagaaccagttctccctgaagctgtcctccgtgaccgccgctgacaccgccgtgtactactgcgctggcggctactacagatacggcctgggctcctactccggctcctactactacgtgatggactactggggccagggcaccaccgtgaccgtgtcctctgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 74 - protein, 111 aa, Artificial Sequence
  source: /note="Description of Artificial Sequence: Synthetic polypeptide"
DTQMTQSPSSLSVSVGDRATITCKASQSVDYEGHSYMNWYQQKPGKAPKLLIYAASNLESGVPSRFSGSGSGTDFTLTISSVQPEDFATYYCQQSNEDPPTFGGGTKLEIK

SEQ ID NO: 75 - DNA, 333 bp, Artificial Sequence
  source: /note="Description of Artificial Sequence: Synthetic polynucleotide"
gacacccagatgacccagtccccctcctccctgtccgtgtccgtgggcgacagagccaccatcacatgcaaggcctcccagtccgtggactacgaaggccattcctacatgaactggtatcagcagaagcccggcaaggcccccaagctgctgatctacgccgcctccaacctggaatccggcgtgccctccagattctccggctccggctctggcaccgacttcaccctgaccatctccagcgtgcagcccgaggacttcgccacctactactgccagcagtccaacgaggacccccccaccttcggcggaggcaccaagctggaaatcaag

SEQ ID NO: 76 - protein, 218 aa, Artificial Sequence
  source: /note="Description of Artificial Sequence: Synthetic polypeptide"
DTQMTQSPSSLSVSVGDRATITCKASQSVDYEGHSYMNWYQQKPGKAPKLLIYAASNLESGVPSRFSGSGSGTDFTLTISSVQPEDFATYYCQQSNEDPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 77 - DNA, 654 bp, Artificial Sequence
  source: /note="Description of Artificial Sequence: Synthetic polynucleotide"
gacacccagatgacccagtccccctcctccctgtccgtgtccgtgggcgacagagccaccatcacatgcaaggcctcccagtccgtggactacgaaggccattcctacatgaactggtatcagcagaagcccggcaaggcccccaagctgctgatctacgccgcctccaacctggaatccggcgtgccctccagattctccggctccggctctggcaccgacttcaccctgaccatctccagcgtgcagcccgaggacttcgccacctactactgccagcagtccaacgaggacccccccaccttcggcggaggcaccaagctggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 78 - protein, 106 aa, Artificial Sequence
  source: /note="Description of Artificial Sequence: Synthetic polypeptide"
EIVLTQSPATLSASPGEEITLSCSASSSVSYIHWYQQKPGQAPRLLIYSTSNLASGIPARFSGSGSGTFYTLTISSVEPEDAAVYYCHQWSSYPWTFGGGTKLEIK

SEQ ID NO: 79 - DNA, 318 bp, Artificial Sequence
  source: /note="Description of Artificial Sequence: Synthetic polynucleotide"
gagatcgtgctgacccagtcccctgccaccctgtctgccagccctggcgaggagatcaccctgtcctgctccgcctcctcctccgtgtcctacatccactggtatcagcagaagcccggccaggcccctcggctgctgatctactccacctccaacctggcctccggcatccctgccagattctccggctctggctccggcaccttttacaccctgaccatctccagcgtggaacccgaggacgccgccgtgtactactgccaccagtggtccagctacccctggaccttcggcggaggcaccaagctggaaatcaag

SEQ ID NO: 80 - protein, 213 aa, Artificial Sequence
  source: /note="Description of Artificial Sequence: Synthetic polypeptide"
EIVLTQSPATLSASPGEEITLSCSASSSVSYIHWYQQKPGQAPRLLIYSTSNLASGIPARFSGSGSGTFYTLTISSVEPEDAAVYYCHQWSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 81 - DNA, 639 bp, Artificial Sequence
  source: /note="Description of Artificial Sequence: Synthetic polynucleotide"
gagatcgtgctgacccagtcccctgccaccctgtctgccagccctggcgaggagatcaccctgtcctgctccgcctcctcctccgtgtcctacatccactggtatcagcagaagcccggccaggcccctcggctgctgatctactccacctccaacctggcctccggcatccctgccagattctccggctctggctccggcaccttttacaccctgaccatctccagcgtggaacccgaggacgccgccgtgtactactgccaccagtggtccagctacccctggaccttcggcggaggcaccaagctggaaatcaagcgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 82 - protein, 7 aa, Artificial Sequence
  source: /note="Description of Artificial Sequence: Synthetic peptide"
SSSAAWN

SEQ ID NO: 83 - protein, 18 aa, Artificial Sequence
  source: /note="Description of Artificial Sequence: Synthetic peptide"
RIYYRSKWYNDYAVSVKS

SEQ ID NO: 84 - protein, 13 aa, Artificial Sequence
  source: /note="Description of Artificial Sequence: Synthetic peptide"
GSYVTSSYEGFDY

SEQ ID NO: 85 - protein, 9 aa, Artificial Sequence
  source: /note="Description of Artificial Sequence: Synthetic peptide"
GDSVSSSSA

SEQ ID NO: 86 - protein, 7 aa, Artificial Sequence
  source: /note="Description of Artificial Sequence: Synthetic peptide"
YYRSKWY

SEQ ID NO: 87 - protein, 12 aa, Artificial Sequence
  source: /note="Description of Artificial Sequence: Synthetic peptide"
GDSVSSSSAAWN

SEQ ID NO: 88 - protein, 10 aa, Artificial Sequence
  source: /note="Description of Artificial Sequence: Synthetic peptide"
GDSVSSSSAA

SEQ ID NO: 89 - protein, 9 aa, Artificial Sequence
  source: /note="Description of Artificial Sequence: Synthetic peptide"
IYYRSKWYN

SEQ ID NO: 90 - protein, 15 aa, Artificial Sequence
  source: /note="Description of Artificial Sequence: Synthetic peptide"
ARGSYVTSSYEGFDY

SEQ ID NO: 91 - protein, 125 aa, Artificial Sequence
  source: /note="Description of Artificial Sequence: Synthetic polypeptide"
QVQLQQSGPGLVKPSQTLSLTCAISGDSVSSSSAAWNWIRQSPSRGLEWLGRIYYRSKWYNDYAVSVKSRITINPDTSKNQFSLQLNSVTPEDTAVYYCARGSYVTSSYEGFDYWGQGTLVTVSS

SEQ ID NO: 92 - DNA, 375 bp, Artificial Sequence
  source: /note="Description of Artificial Sequence: Synthetic polynucleotide"
caggtgcaattgcagcagagcggtccgggcctggtgaaaccgagccagaccctgagcctgacctgcgcgatttccggagatagcgtgagctctagctctgctgcttggaactggattcgtcagagcccgagccgtggcctcgagtggctgggccgtatctactaccgtagcaaatggtacaacgactatgccgtgagcgtgaaaagccgcattaccattaacccggatacttcgaaaaaccagtttagcctgcaactgaacagcgtgaccccggaagatacggccgtgtattattgcgcgcgtggttcttacgttacttcttcttacgaaggtttcgattactggggccaaggcaccctggtgactgttagctca

SEQ ID NO: 93 - protein, 455 aa, Artificial Sequence
  source: /note="Description of Artificial Sequence: Synthetic polypeptide"
QVQLQQSGPGLVKPSQTLSLTCAISGDSVSSSSAAWNWIRQSPSRGLEWLGRIYYRSKWYNDYAVSVKSRITINPDTSKNQFSLQLNSVTPEDTAVYYCARGSYVTSSYEGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - DNA, 1365 bp, Artificial Sequence
  source: /note="Description of Artificial Sequence: Synthetic polynucleotide"
caggtgcaattgcagcagagcggtccgggcctggtgaaaccgagccagaccctgagcctgacctgcgcgatttccggagatagcgtgagctctagctctgctgcttggaactggattcgtcagagcccgagccgtggcctcgagtggctgggccgtatctactaccgtagcaaatggtacaacgactatgccgtgagcgtgaaaagccgcattaccattaacccggatacttcgaaaaaccagtttagcctgcaactgaacagcgtgaccccggaagatacggccgtgtattattgcgcgcgtggttcttacgttacttcttcttacgaaggtttcgattactggggccaaggcaccctggtgactgttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 95 - protein, 11 aa, Artificial Sequence
  source: /note="Description of Artificial Sequence: Synthetic peptide"
SGDNLPEKYAY

SEQ ID NO: 96 - protein, 7 aa, Artificial Sequence
  source: /note="Description of Artificial Sequence: Synthetic peptide"
DDNKRPS

SEQ ID NO: 97 - protein, 11 aa, Artificial Sequence
  source: /note="Description of Artificial Sequence: Synthetic peptide"
QSYGKWGWTWV

SEQ ID NO: 98 - protein, 7 aa, Artificial Sequence
  source: /note="Description of Artificial Sequence: Synthetic peptide"
DNLPEKY

SEQ ID NO: 99 - protein, 3 aa, Artificial Sequence
  source: /note="Description of Artificial Sequence: Synthetic peptide"
DDN

SEQ ID NO: 100 - protein, 8 aa, Artificial Sequence
  source: /note="Description of Artificial Sequence: Synthetic peptide"
YGKWGWTW

SEQ ID NO: 101 - protein, 6 aa, Artificial Sequence
  source: /note="Description of Artificial Sequence: Synthetic peptide"
NLPEKY

SEQ ID NO: 102 - protein, 108 aa, Artificial Sequence
  source: /note="Description of Artificial Sequence: Synthetic polypeptide"
SYELTQPLSVSVALGQTARITCSGDNLPEKYAYWYQQKPGQAPVLVIYDDNKRPSGIPERFSGSNSGNTATLTISRAQAGDEADYYCQSYGKWGWTWVFGGGTKLTVL

SEQ ID NO: 103 - DNA, 324 bp, Artificial Sequence
  source: /note="Description of Artificial Sequence: Synthetic polynucleotide"
agctacgaactgacccagccgctgtccgtgagcgtggctctgggccagaccgcgcggattacctgtagcggcgataacctgccggaaaaatacgcttactggtaccagcagaaaccgggccaggcgccggtgctggtgatctacgacgacaacaaacgtccgagcggcatcccggaacgttttagcggatccaacagcggcaacaccgcgaccctgaccattagccgcgcccaggcgggagacgaagcggattattactgccagtcttacggtaaatggggttggacttgggtgtttggcggcggcacgaagttaaccgtccta

SEQ ID NO: 104 - protein, 214 aa, Artificial Sequence
  source: /note="Description of Artificial Sequence: Synthetic polypeptide"
SYELTQPLSVSVALGQTARITCSGDNLPEKYAYWYQQKPGQAPVLVIYDDNKRPSGIPERFSGSNSGNTATLTISRAQAGDEADYYCQSYGKWGWTWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 105 - DNA, 642 bp, Artificial Sequence
  source: /note="Description of Artificial Sequence: Synthetic polynucleotide"
agctacgaactgacccagccgctgtccgtgagcgtggctctgggccagaccgcgcggattacctgtagcggcgataacctgccggaaaaatacgcttactggtaccagcagaaaccgggccaggcgccggtgctggtgatctacgacgacaacaaacgtccgagcggcatcccggaacgttttagcggatccaacagcggcaacaccgcgaccctgaccattagccgcgcccaggcgggagacgaagcggattattactgccagtcttacggtaaatggggttggacttgggtgtttggcggcggcacgaagttaaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 106 - protein, 5 aa, Artificial Sequence
  source: /note="Description of Artificial Sequence: Synthetic peptide"
SYAVS

SEQ ID NO: 107 - protein, 17 aa, Artificial Sequence
  source: /note="Description of Artificial Sequence: Synthetic peptide"
RIVPWLGHTQYAQKFQG

SEQ ID NO: 108 - protein, 11 aa, Artificial Sequence
  source: /note="Description of Artificial Sequence: Synthetic peptide"
ESPGYRYSFDV

SEQ ID NO: 109 - protein, 7 aa, Artificial Sequence
  source: /note="Description of Artificial Sequence: Synthetic peptide"
GGTFDSY

SEQ ID NO: 110 - protein, 6 aa, Artificial Sequence
  source: /note="Description of Artificial Sequence: Synthetic peptide"
VPWLGH

SEQ ID NO: 111 - protein, 10 aa, Artificial Sequence
  source: /note="Description of Artificial Sequence: Synthetic peptide"
GGTFDSYAVS

SEQ ID NO: 112 - protein, 8 aa, Artificial Sequence
  source: /note="Description of Artificial Sequence: Synthetic peptide"
GGTFDSYA

SEQ ID NO: 113 - protein, 8 aa, Artificial Sequence
  source: /note="Description of Artificial Sequence: Synthetic peptide"
IVPWLGHT

SEQ ID NO: 114 - protein, 13 aa, Artificial Sequence
  source: /note="Description of Artificial Sequence: Synthetic peptide"
ARESPGYRYSFDV

SEQ ID NO: 115 - protein, 120 aa, Artificial Sequence
  source: /note="Description of Artificial Sequence: Synthetic polypeptide"
QVQLVQSGAEVKKPGSSVKVSCKASGGTFDSYAVSWVRQAPGQGLEWMGRIVPWLGHTQYAQKFQGRVTITADESTSTAYMELSSLRSEDTAVYYCARESPGYRYSFDVWDQGTLVTVSS

SEQ ID NO: 116 - DNA, 360 bp, Artificial Sequence
  source: /note="Description of Artificial Sequence: Synthetic polynucleotide"
caggtgcaattggtgcagagcggtgccgaagtgaaaaaaccgggcagcagcgtgaaagttagctgcaaagcatccggagggacgtttgactcttacgctgtttcttgggtgcgccaggccccgggccagggcctcgagtggatgggccgtatcgttccgtggctgggccatactcagtacgcccagaaatttcagggccgggtgaccattaccgccgatgaaagcaccagcaccgcctatatggaactgagcagcctgcgcagcgaagatacggccgtgtattattgcgcgcgtgaatctccgggttaccgttactctttcgatgtttgggaccaaggcaccctggtgactgttagctca

SEQ ID NO: 117 - protein, 450 aa, Artificial Sequence
  source: /note="Description of Artificial Sequence: Synthetic polypeptide"
QVQLVQSGAEVKKPGSSVKVSCKASGGTFDSYAVSWVRQAPGQGLEWMGRIVPWLGHTQYAQKFQGRVTITADESTSTAYMELSSLRSEDTAVYYCARESPGYRYSFDVWDQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - DNA, 1350 bp, Artificial Sequence
  source: /note="Description of Artificial Sequence: Synthetic polynucleotide"
caggtgcaattggtgcagagcggtgccgaagtgaaaaaaccgggcagcagcgtgaaagttagctgcaaagcatccggagggacgtttgactcttacgctgtttcttgggtgcgccaggccccgggccagggcctcgagtggatgggccgtatcgttccgtggctgggccatactcagtacgcccagaaatttcagggccgggtgaccattaccgccgatgaaagcaccagcaccgcctatatggaactgagcagcctgcgcagcgaagatacggccgtgtattattgcgcgcgtgaatctccgggttaccgttactctttcgatgtttgggaccaaggcaccctggtgactgttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 119 - protein, 11 aa, Artificial Sequence
  source: /note="Description of Artificial Sequence: Synthetic peptide"
SGDAIGEKYVY

SEQ ID NO: 120 - protein, 7 aa, Artificial Sequence
  source: /note="Description of Artificial Sequence: Synthetic peptide"
DDNNRPS

SEQ ID NO: 121 - protein, 11 aa, Artificial Sequence
  source: /note="Description of Artificial Sequence: Synthetic peptide"
ASYDLQQARWV

SEQ ID NO: 122 - protein, 7 aa, Artificial Sequence
  source: /note="Description of Artificial Sequence: Synthetic peptide"
DAIGEKY

SEQ ID NO: 123 - protein, 8 aa, Artificial Sequence
  source: /note="Description of Artificial Sequence: Synthetic peptide"
YDLQQARW

SEQ ID NO: 124 - protein, 6 aa, Artificial Sequence
  source: /note="Description of Artificial Sequence: Synthetic peptide"
AIGEKY

SEQ ID NO: 125 - protein, 108 aa, Artificial Sequence
  source: /note="Description of Artificial Sequence: Synthetic polypeptide"
SYELTQPLSVSVALGQTARITCSGDAIGEKYVYWYQQKPGQAPVLVIYDDNNRPSGIPERFSGSNSGNTATLTISRAQAGDEADYYCASYDLQQARWVFGGGTKLTVL

SEQ ID NO: 126 - DNA, 324 bp, Artificial Sequence
  source: /note="Description of Artificial Sequence: Synthetic polynucleotide"
agctacgaactgacccagccgctgtccgtgagcgtggctctgggccagaccgcgcggattacctgtagcggcgatgctatcggtgaaaaatacgtttactggtaccagcagaaaccgggccaggcgccggtgctggtgatctacgacgacaacaaccgtccgagcggcatcccggaacgttttagcggatccaacagcggcaacaccgcgaccctgaccattagccgcgcccaggcgggagacgaagcggattattactgcgcttcttacgacctgcagcaggctcgttgggtgtttggcggcggcacgaagttaaccgtccta

SEQ ID NO: 127 - protein, 214 aa, Artificial Sequence
  source: /note="Description of Artificial Sequence: Synthetic polypeptide"
SYELTQPLSVSVALGQTARITCSGDAIGEKYVYWYQQKPGQAPVLVIYDDNNRPSGIPERFSGSNSGNTATLTISRAQAGDEADYYCASYDLQQARWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 128 - DNA, 642 bp, Artificial Sequence
  source: /note="Description of Artificial Sequence: Synthetic polynucleotide"
agctacgaactgacccagccgctgtccgtgagcgtggctctgggccagaccgcgcggattacctgtagcggcgatgctatcggtgaaaaatacgtttactggtaccagcagaaaccgggccaggcgccggtgctggtgatctacgacgacaacaaccgtccgagcggcatcccggaacgttttagcggatccaacagcggcaacaccgcgaccctgaccattagccgcgcccaggcgggagacgaagcggattattactgcgcttcttacgacctgcagcaggctcgttgggtgtttggcggcggcacgaagttaaccgtcctaggtcagcccaaggctgccccctcggtcactctgttcccgccctcctctgaggagcttcaagccaacaaggccacactggtgtgtctcataagtgacttctacccgggagccgtgacagtggcctggaaggcagatagcagccccgtcaaggcgggagtggagaccaccacaccctccaaacaaagcaacaacaagtacgcggccagcagctatctgagcctgacgcctgagcagtggaagtcccacagaagctacagctgccaggtcacgcatgaagggagcaccgtggagaagacagtggcccctacagaatgttca

SEQ ID NO: 129 - protein, 17 aa, Artificial Sequence
  source: /note="Description of Artificial Sequence: Synthetic peptide"
RIVPWLGFTRYAQKFQG

SEQ ID NO: 130 - protein, 6 aa, Artificial Sequence
  source: /note="Description of Artificial Sequence: Synthetic peptide"
VPWLGF

SEQ ID NO: 131 - protein, 8 aa, Artificial Sequence
  source: /note="Description of Artificial Sequence: Synthetic peptide"
IVPWLGFT

SEQ ID NO: 132 - protein, 120 aa, Artificial Sequence
  source: /note="Description of Artificial Sequence: Synthetic polypeptide"
QVQLVQSGAEVKKPGSSVKVSCKASGGTFDSYAVSWVRQAPGQGLEWMGRIVPWLGFTRYAQKFQGRVTITADESTSTAYMELSSLRSEDTAVYYCARESPGYRYSFDVWDQGTLVTVSS

SEQ ID NO: 133 - DNA, 360 bp, Artificial Sequence
  source: /note="Description of Artificial Sequence: Synthetic polynucleotide"
caggtgcaattggtgcagagcggtgccgaagtgaaaaaaccgggcagcagcgtgaaagttagctgcaaagcatccggagggacgtttgactcttacgctgtttcttgggtgcgccaggccccgggccagggcctcgagtggatgggccgtatcgttccgtggctgggcttcactcgttacgcccagaaatttcagggccgggtgaccattaccgccgatgaaagcaccagcaccgcctatatggaactgagcagcctgcgcagcgaagatacggccgtgtattattgcgcgcgtgaatctccgggttaccgttactctttcgatgtttgggaccaaggcaccctggtgactgttagctca

SEQ ID NO: 134 - protein, 450 aa, Artificial Sequence
  source: /note="Description of Artificial Sequence: Synthetic polypeptide"
QVQLVQSGAEVKKPGSSVKVSCKASGGTFDSYAVSWVRQAPGQGLEWMGRIVPWLGFTRYAQKFQGRVTITADESTSTAYMELSSLRSEDTAVYYCARESPGYRYSFDVWDQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - DNA, 1350 bp, Artificial Sequence
  source: /note="Description of Artificial Sequence: Synthetic polynucleotide"
caggtgcaattggtgcagagcggtgccgaagtgaaaaaaccgggcagcagcgtgaaagttagctgcaaagcatccggagggacgtttgactcttacgctgtttcttgggtgcgccaggccccgggccagggcctcgagtggatgggccgtatcgttccgtggctgggcttcactcgttacgcccagaaatttcagggccgggtgaccattaccgccgatgaaagcaccagcaccgcctatatggaactgagcagcctgcgcagcgaagatacggccgtgtattattgcgcgcgtgaatctccgggttaccgttactctttcgatgtttgggaccaaggcaccctggtgactgttagctcagcctccaccaagggtccatcggtcttccccctggcaccctcctccaagagcacctctgggggcacagcggccctgggctgcctggtcaaggactacttccccgaaccggtgacggtgtcgtggaactcaggcgccctgaccagcggcgtgcacaccttcccggctgtcctacagtcctcaggactctactccctcagcagcgtggtgaccgtgccctccagcagcttgggcacccagacctacatctgcaacgtgaatcacaagcccagcaacaccaaggtggacaagagagttgagcccaaatcttgtgacaaaactcacacatgcccaccgtgcccagcacctgaactcctggggggaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgggtggtcagcgtcctcaccgtcctgcaccaggactggctgaatggcaaggagtacaagtgcaaggtctccaacaaagccctcccagcccccatcgagaaaaccatctccaaagccaaagggcagccccgagaaccacaggtgtacaccctgcccccatcccgggaggagatgaccaagaaccaggtcagcctgacctgcctggtcaaaggcttctatcccagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtaaa

SEQ ID NO: 136 - protein, 5 aa, Artificial Sequence
  source: /note="Description of Artificial Sequence: Synthetic peptide"
SYAMS

SEQ ID NO: 137 - protein, 17 aa, Artificial Sequence
  source: /note="Description of Artificial Sequence: Synthetic peptide"
VISGSGGSTYYADSVKG

SEQ ID NO: 138 - protein, 15 aa, Artificial Sequence
  source: /note="Description of Artificial Sequence: Synthetic peptide"
GDDYGDDYYYYGMDV

SEQ ID NO: 139 - protein, 7 aa, Artificial Sequence
  source: /note="Description of Artificial Sequence: Synthetic peptide"
GFTFSSY

SEQ ID NO: 140 - protein, 6 aa, Artificial Sequence
  source: /note="Description of Artificial Sequence: Synthetic peptide"
SGSGGS

SEQ ID NO: 141 - protein, 10 aa, Artificial Sequence
  source: /note="Description of Artificial Sequence: Synthetic peptide"
GFTFSSYAMS

SEQ ID NO: 142 - protein, 8 aa, Artificial Sequence
  source: /note="Description of Artificial Sequence: Synthetic peptide"
GFTFSSYA

SEQ ID NO: 143 - protein, 8 aa, Artificial Sequence
  source: /note="Description of Artificial Sequence: Synthetic peptide"
ISGSGGST

SEQ ID NO: 144 - protein, 17 aa, Artificial Sequence
  source: /note="Description of Artificial Sequence: Synthetic peptide"
ARGDDYGDDYYYYGMDV

SEQ ID NO: 145 - protein, 124 aa, Artificial Sequence
  source: /note="Description of Artificial Sequence: Synthetic polypeptide"
EVQLLESGGGLVQSGGSLRLSCAASGFTFSSYAMSWVRQAPGKGLEWVSVISGSGGSTYYADSVKGRFTISRDNSKNTLYLQMNSLRAEDTAVYYCARGDDYGDDYYYYGMDVWGQGTTVTVSS

SEQ ID NO: 146 - DNA, 372 bp, Artificial Sequence
  source: /note="Description of Artificial Sequence: Synthetic polynucleotide"
gaggtgcagctgttggagtctgggggaggcttggtacagtctggggggtccctgagactctcctgtgcagcctctggattcacctttagcagctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgagaggggatgactacggtgacgactactactactacggtatggacgtctggggccaagggaccacggtcaccgtctcctca

SEQ ID NO: 147 - protein, 454 aa, Artificial Sequence
  source: /note="Description of Artificial Sequence: Synthetic polypeptide"
EVQLLESGGGLVQSGGSLRLSCAASGFTFSSYAMSWVRQAPGKGLEWVSVISGSGGSTYYADSVKGRFTISRDNSKNTLYLQMNSLRAEDTAVYYCARGDDYGDDYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 148 - DNA, 1362 bp, Artificial Sequence
  source: /note="Description of Artificial Sequence: Synthetic polynucleotide"
gaggtgcagctgttggagtctgggggaggcttggtacagtctggggggtccctgagactctcctgtgcagcctctggattcacctttagcagctatgccatgagctgggtccgccaggctccagggaaggggctggagtgggtctcagttattagtggtagtggtggtagcacatactacgcagactccgtgaagggccggttcaccatctccagagacaattccaagaacacgctgtatctgcaaatgaacagcctgagagccgaggacacggccgtatattactgtgcgagaggggatgactacggtgacgactactactactacggtatggacgtctggggccaagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 149 - protein, 16 aa, Artificial Sequence
  source: /note="Description of Artificial Sequence: Synthetic peptide"
RSSQSLLHGNRYNYLD

SEQ ID NO: 150 - protein, 7 aa, Artificial Sequence
  source: /note="Description of Artificial Sequence: Synthetic peptide"
LGSNRAS

SEQ ID NO: 151 - protein, 9 aa, Artificial Sequence
  source: /note="Description of Artificial Sequence: Synthetic peptide"
MQALQTPPT

SEQ ID NO: 152 - protein, 12 aa, Artificial Sequence
  source: /note="Description of Artificial Sequence: Synthetic peptide"
SQSLLHGNRYNY

SEQ ID NO: 153 - protein, 3 aa, Artificial Sequence
  source: /note="Description of Artificial Sequence: Synthetic peptide"
LGS

SEQ ID NO: 154 - protein, 6 aa, Artificial Sequence
  source: /note="Description of Artificial Sequence: Synthetic peptide"
ALQTPP

SEQ ID NO: 155 - protein, 11 aa, Artificial Sequence
  source: /note="Description of Artificial Sequence: Synthetic peptide"
QSLLHGNRYNY

SEQ ID NO: 156 - protein, 112 aa, Artificial Sequence
  source: /note="Description of Artificial Sequence: Synthetic polypeptide"
DIVMTQSPLSLPVTPGEPASISCRSSQSLLHGNRYNYLDWYLQKPGQSPQLLIYLGSNRASGVPDRFSGSGSGTDFTLKISRVEAEDVGVYYCMQALQTPPTFGQGTKVEIK

SEQ ID NO: 157 - DNA, 336 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatggtaatcgatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctccgacgttcggccaagggaccaaggtggaaatcaaa

SEQ ID NO: 158 - protein, 219 aa, Artificial Sequence
  source: /note="Description of Artificial Sequence: Synthetic polypeptide"
DIVMTQSPLSLPVTPGEPASISCRSSQSLLHGNRYNYLDWYLQKPGQSPQLLIYLGSNRASGVPDRFSGSGSGTDFTLKISRVEAEDVGVYYCMQALQTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 159 - DNA, 657 bp, Artificial Sequence
  source: /note="Description of Artificial Sequence: Synthetic polynucleotide"
gatattgtgatgactcagtctccactctccctgcccgtcacccctggagagccggcctccatctcctgcaggtctagtcagagcctcctgcatggtaatcgatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctccgacgttcggccaagggaccaaggtggaaatcaaacgaactgtggctgcaccaagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 160 - protein, 5 aa, Artificial Sequence
  source: /note="Description of Artificial Sequence: Synthetic peptide"
SCSMN

SEQ ID NO: 161 - protein, 17 aa, Artificial Sequence
  source: /note="Description of Artificial Sequence: Synthetic peptide"
YISSSSSTIYYADSVKG

SEQ ID NO: 162 - protein, 16 aa, Artificial Sequence
  source: /note="Description of Artificial Sequence: Synthetic peptide"
DQGNWNYDDYYNGLDV

SEQ ID NO: 163 - protein, 7 aa, Artificial Sequence
  source: /note="Description of Artificial Sequence: Synthetic peptide"
GFTFNSC

SEQ ID NO: 164 - protein, 6 aa, Artificial Sequence
  source: /note="Description of Artificial Sequence: Synthetic peptide"
SSSSST

SEQ ID NO: 165 - protein, 10 aa, Artificial Sequence
  source: /note="Description of Artificial Sequence: Synthetic peptide"
GFTFNSCSMN

SEQ ID NO: 166 - protein, 8 aa, Artificial Sequence
  source: /note="Description of Artificial Sequence: Synthetic peptide"
GFTFNSCS

SEQ ID NO: 167 - protein, 8 aa, Artificial Sequence
  source: /note="Description of Artificial Sequence: Synthetic peptide"
ISSSSSTI

SEQ ID NO: 168 - protein, 18 aa, Artificial Sequence
  source: /note="Description of Artificial Sequence: Synthetic peptide"
ARDQGNWNYDDYYNGLDV

SEQ ID NO: 169 - protein, 125 aa, Artificial Sequence
  source: /note="Description of Artificial Sequence: Synthetic polypeptide"
EVLLVESGGGLVQPGGSLRLSCAASGFTFNSCSMNWVRQAPGKGLEWVSYISSSSSTIYYADSVKGRFTISRDNAKNSLYLQMNSLKDEDTAVYYCARDQGNWNYDDYYNGLDVWGQGTTVTVSS

SEQ ID NO: 170 - DNA, 375 bp, Artificial Sequence
  source: /note="Description of Artificial Sequence: Synthetic polynucleotide"
gaggtgctgctggtggagtctgggggaggcttggtacagcctggggggtccctgagactctcctgtgcagcctctgggttcaccttcaatagctgtagcatgaactgggtccgccaggctccagggaaggggctggagtgggtttcatacattagtagtagtagtagtaccatttactacgcagactctgtgaagggccgattcaccatctccagagacaatgccaagaactcactgtatctgcaaatgaacagcctgaaagacgaggacacggctgtgtattactgtgcgagagatcagggtaactggaactacgacgactactacaacggtttggacgtctggggccaagggaccacggtcaccgtctcctca

SEQ ID NO: 171 - protein, 455 aa, Artificial Sequence
  source: /note="Description of Artificial Sequence: Synthetic polypeptide"
EVLLVESGGGLVQPGGSLRLSCAASGFTFNSCSMNWVRQAPGKGLEWVSYISSSSSTIYYADSVKGRFTISRDNAKNSLYLQMNSLKDEDTAVYYCARDQGNWNYDDYYNGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 172 - DNA, 1365 bp, Artificial Sequence
  source: /note="Description of Artificial Sequence: Synthetic polynucleotide"
gaggtgctgctggtggagtctgggggaggcttggtacagcctggggggtccctgagactctcctgtgcagcctctgggttcaccttcaatagctgtagcatgaactgggtccgccaggctccagggaaggggctggagtgggtttcatacattagtagtagtagtagtaccatttactacgcagactctgtgaagggccgattcaccatctccagagacaatgccaagaactcactgtatctgcaaatgaacagcctgaaagacgaggacacggctgtgtattactgtgcgagagatcagggtaactggaactacgacgactactacaacggtttggacgtctggggccaagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 173 - protein, 16 aa, Artificial Sequence
  source: /note="Description of Artificial Sequence: Synthetic peptide"
RSSQSLLHSNGYNYLD

SEQ ID NO: 174 - protein, 9 aa, Artificial Sequence
  source: /note="Description of Artificial Sequence: Synthetic peptide"
MQALQTPLT

SEQ ID NO: 175 - protein, 12 aa, Artificial Sequence
  source: /note="Description of Artificial Sequence: Synthetic peptide"
SQSLLHSNGYNY

SEQ ID NO: 176 - protein, 6 aa, Artificial Sequence
  source: /note="Description of Artificial Sequence: Synthetic peptide"
ALQTPL

SEQ ID NO: 177 - protein, 11 aa, Artificial Sequence
  source: /note="Description of Artificial Sequence: Synthetic peptide"
QSLLHSNGYNY

SEQ ID NO: 178 - protein, 112 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIK

SEQ ID NO: 179 - DNA, 336 bp, Artificial Sequence
  source: /note="Description of Artificial Sequence: Synthetic polynucleotide"
gatattgtgatgactcagtctccactctccctgcccgtcactcctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcactttcggcggagggaccaaggtggagatcaaa

SEQ ID NO: 180 - protein, 219 aa, Artificial Sequence
  source: /note="Description of Artificial Sequence: Synthetic polypeptide"
DIVMTQSPLSLPVTPGEPASISCRSSQSLLHSNGYNYLDWYLQKPGQSPQLLIYLGSNRASGVPDRFSGSGSGTDFTLKISRVEAEDVGVYYCMQALQTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 181 - DNA, 657 bp, Artificial Sequence
  source: /note="Description of Artificial Sequence: Synthetic polynucleotide"
gatattgtgatgactcagtctccactctccctgcccgtcactcctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctctcactttcggcggagggaccaaggtggagatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 182 - protein, 5 aa, Artificial Sequence
  source: /note="Description of Artificial Sequence: Synthetic peptide"
HYGMN

SEQ ID NO: 183 - protein, 17 aa, Artificial Sequence
  source: /note="Description of Artificial Sequence: Synthetic peptide"
WINTDTGNPTYADDFKG

SEQ ID NO: 184 - protein, 14 aa, Artificial Sequence
  source: /note="Description of Artificial Sequence: Synthetic peptide"
YGTLYSGYGFFFDS

SEQ ID NO: 185 - protein, 7 aa, Artificial Sequence
  source: /note="Description of Artificial Sequence: Synthetic peptide"
GYTFTHY

SEQ ID NO: 186 - protein, 6 aa, Artificial Sequence
  source: /note="Description of Artificial Sequence: Synthetic peptide"
NTDTGN

SEQ ID NO: 187 - protein, 10 aa, Artificial Sequence
  source: /note="Description of Artificial Sequence: Synthetic peptide"
GYTFTHYGMN

SEQ ID NO: 188 - protein, 8 aa, Artificial Sequence
  source: /note="Description of Artificial Sequence: Synthetic peptide"
GYTFTHYG

SEQ ID NO: 189 - protein, 8 aa, Artificial Sequence
  source: /note="Description of Artificial Sequence: Synthetic peptide"
INTDTGNP

SEQ ID NO: 190 - protein, 16 aa, Artificial Sequence
  source: /note="Description of Artificial Sequence: Synthetic peptide"
VRYGTLYSGYGFFFDS

SEQ ID NO: 191 - protein, 123 aa, Artificial Sequence
  source: /note="Description of Artificial Sequence: Synthetic polypeptide"
QVQLVQSGAELKQPGQSVKISCKASGYTFTHYGMNWVKQAPGQGLKWMGWINTDTGNPTYADDFKGRFVFSLDTSVSTAYLQISNLKNEDTATYYCVRYGTLYSGYGFFFDSWGQGTLVTVSS

SEQ ID NO: 192 - DNA, 369 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttcacacactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctca

SEQ ID NO: 193 - protein, 453 aa, Artificial Sequence
  source: /note="Description of Artificial Sequence: Synthetic polypeptide"
QVQLVQSGAELKQPGQSVKISCKASGYTFTHYGMNWVKQAPGQGLKWMGWINTDTGNPTYADDFKGRFVFSLDTSVSTAYLQISNLKNEDTATYYCVRYGTLYSGYGFFFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 194 - DNA, 1359 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttcacacactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctcagccaagaccaccgcccccagcgtgtaccccctggcccccgtgtgcggcgataccaccggcagcagcgtgaccctgggctgcctggtgaagggctacttccccgagcccgtgaccctgacctggaacagcggctccctgagcagcggcgtgcacaccttccccgccgtgctgcagagcgacctgtacaccctgtccagctccgtgaccgtgacaagcagcacctggcccagccagagcatcacctgcaacgtggcccaccccgccagcagcaccaaggtggacaagaagatcgagcccaggggccccaccatcaagccctgccccccctgcaagtgcccagcccccaacctgctgggcggacccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccaccgggaggactacaacagcaccctgcgcgtcgtgtccgccctgcccatccagcaccaggactggatgagcggcaaagaattcaagtgcaaggtgaacaacaaggacctgcctgcccccatcgagcggaccatcagcaagcccaagggcagcgtgagagccccccaggtgtacgtgctgccccctcccgaggaagagatgaccaagaaacaggtgacactgacctgcatggtgaccgacttcatgcccgaggacatctacgtggagtggaccaacaacggcaagaccgagctgaactacaagaacaccgagcctgtgctggacagcgacggcagctacttcatgtacagcaagctgcgggtggagaagaaaaactgggtggagcggaacagctacagctgcagcgtggtgcacgagggcctgcacaaccaccacaccaccaagagcttcagccggacccccggcaag

SEQ ID NO: 195 - protein, 17 aa, Artificial Sequence
  source: /note="Description of Artificial Sequence: Synthetic peptide"
KSSQSLFNSNTNKNYLN

SEQ ID NO: 196 - protein, 7 aa, Artificial Sequence
  source: /note="Description of Artificial Sequence: Synthetic peptide"
YASTRHT

SEQ ID NO: 197 - protein, 9 aa, Artificial Sequence
  source: /note="Description of Artificial Sequence: Synthetic peptide"
QQWYSYPWT

SEQ ID NO: 198 - protein, 13 aa, Artificial Sequence
  source: /note="Description of Artificial Sequence: Synthetic peptide"
SQSLFNSNTNKNY

SEQ ID NO: 199 - protein, 3 aa, Artificial Sequence
  source: /note="Description of Artificial Sequence: Synthetic peptide"
YAS

SEQ ID NO: 200 - protein, 6 aa, Artificial Sequence
  source: /note="Description of Artificial Sequence: Synthetic peptide"
WYSYPW

SEQ ID NO: 201 - protein, 12 aa, Artificial Sequence
  source: /note="Description of Artificial Sequence: Synthetic peptide"
QSLFNSNTNKNY

SEQ ID NO: 202 - protein, 113 aa, Artificial Sequence
  source: /note="Description of Artificial Sequence: Synthetic polypeptide"
DIMMTQSPSSLSVSAGEKATITCKSSQSLFNSNTNKNYLNWYLQKPGQSPKLLFYYASTRHTGVPDRFIGSGSGTDFTLTITSVQDEDLADYYCQQWYSYPWTFGPGTKLEIK

SEQ ID NO: 203 - DNA, 339 bp, Artificial Sequence
  source: /note="Description of Artificial Sequence: Synthetic polynucleotide"
gacatcatgatgacccagtctccatcatccctgagtgtgtcagcaggagagaaagccactatcacctgcaagtccagtcagagtcttttcaacagtaacaccaacaagaactacttgaactggtacctgcagaaaccagggcagtctcctaaactgctgttctattatgcatccactaggcatactggggtccctgatcgcttcataggcagtggatctgggacagatttcactctcaccatcaccagtgtccaggatgaagacctggcagattattactgtcagcagtggtatagctacccgtggacgttcggacctggcaccaagctggaaatcaaa

SEQ ID NO: 204 - protein, 220 aa, Artificial Sequence
  source: /note="Description of Artificial Sequence: Synthetic polypeptide"
DIMMTQSPSSLSVSAGEKATITCKSSQSLFNSNTNKNYLNWYLQKPGQSPKLLFYYASTRHTGVPDRFIGSGSGTDFTLTITSVQDEDLADYYCQQWYSYPWTFGPGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 205 - DNA, 660 bp, Artificial Sequence
  source: /note="Description of Artificial Sequence: Synthetic polynucleotide"
gacatcatgatgacccagtctccatcatccctgagtgtgtcagcaggagagaaagccactatcacctgcaagtccagtcagagtcttttcaacagtaacaccaacaagaactacttgaactggtacctgcagaaaccagggcagtctcctaaactgctgttctattatgcatccactaggcatactggggtccctgatcgcttcataggcagtggatctgggacagatttcactctcaccatcaccagtgtccaggatgaagacctggcagattattactgtcagcagtggtatagctacccgtggacgttcggacctggcaccaagctggaaatcaaacgcgctgatgccgcccctaccgtgagcatcttcccccccagcagcgagcagctgaccagcggcggagccagcgtggtgtgcttcctgaacaacttctaccccaaggacatcaacgtgaagtggaagatcgacggcagcgagcggcagaacggcgtgctgaacagctggaccgaccaggacagcaaggactccacctacagcatgagcagcaccctgaccctgaccaaggacgagtacgagcggcacaacagctacacctgcgaggccacccacaagaccagcaccagccccatcgtgaagagcttcaaccggaacgagtgc

SEQ ID NO: 206 - protein, 7 aa, Artificial Sequence
  source: /note="Description of Artificial Sequence: Synthetic peptide"
GYTFWHY

SEQ ID NO: 207 - protein, 10 aa, Artificial Sequence
  source: /note="Description of Artificial Sequence: Synthetic peptide"
GYTFWHYGMN

SEQ ID NO: 208 - protein, 8 aa, Artificial Sequence
  source: /note="Description of Artificial Sequence: Synthetic peptide"
GYTFWHYG

SEQ ID NO: 209 - protein, 123 aa, Artificial Sequence
  source: /note="Description of Artificial Sequence: Synthetic polypeptide"
QVQLVQSGAELKQPGQSVKISCKASGYTFWHYGMNWVKQAPGQGLKWMGWINTDTGNPTYADDFKGRFVFSLDTSVSTAYLQISNLKNEDTATYYCVRYGTLYSGYGFFFDSWGQGTLVTVSS

SEQ ID NO: 210 - DNA, 369 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttctggcactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctca

SEQ ID NO: 211 - protein, 453 aa, Artificial Sequence
  source: /note="Description of Artificial Sequence: Synthetic polypeptide"
QVQLVQSGAELKQPGQSVKISCKASGYTFWHYGMNWVKQAPGQGLKWMGWINTDTGNPTYADDFKGRFVFSLDTSVSTAYLQISNLKNEDTATYYCVRYGTLYSGYGFFFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 212 - DNA, 1359 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttctggcactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctcagccaagaccaccgcccccagcgtgtaccccctggcccccgtgtgcggcgataccaccggcagcagcgtgaccctgggctgcctggtgaagggctacttccccgagcccgtgaccctgacctggaacagcggctccctgagcagcggcgtgcacaccttccccgccgtgctgcagagcgacctgtacaccctgtccagctccgtgaccgtgacaagcagcacctggcccagccagagcatcacctgcaacgtggcccaccccgccagcagcaccaaggtggacaagaagatcgagcccaggggccccaccatcaagccctgccccccctgcaagtgcccagcccccaacctgctgggcggacccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccaccgggaggactacaacagcaccctgcgcgtcgtgtccgccctgcccatccagcaccaggactggatgagcggcaaagaattcaagtgcaaggtgaacaacaaggacctgcctgcccccatcgagcggaccatcagcaagcccaagggcagcgtgagagccccccaggtgtacgtgctgccccctcccgaggaagagatgaccaagaaacaggtgacactgacctgcatggtgaccgacttcatgcccgaggacatctacgtggagtggaccaacaacggcaagaccgagctgaactacaagaacaccgagcctgtgctggacagcgacggcagctacttcatgtacagcaagctgcgggtggagaagaaaaactgggtggagcggaacagctacagctgcagcgtggtgcacgagggcctgcacaaccaccacaccaccaagagcttcagccggacccccggcaag

SEQ ID NO: 213 - protein, 7 aa, Artificial Sequence
  source: /note="Description of Artificial Sequence: Synthetic peptide"
GYTFHHY

SEQ ID NO: 214 - protein, 10 aa, Artificial Sequence
  source: /note="Description of Artificial Sequence: Synthetic peptide"
GYTFHHYGMN

SEQ ID NO: 215 - protein, 8 aa, Artificial Sequence
  source: /note="Description of Artificial Sequence: Synthetic peptide"
GYTFHHYG

SEQ ID NO: 216 - protein, 123 aa, Artificial Sequence
  source: /note="Description of Artificial Sequence: Synthetic polypeptide"
QVQLVQSGAELKQPGQSVKISCKASGYTFHHYGMNWVKQAPGQGLKWMGWINTDTGNPTYADDFKGRFVFSLDTSVSTAYLQISNLKNEDTATYYCVRYGTLYSGYGFFFDSWGQGTLVTVSS

SEQ ID NO: 217 - DNA, 369 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttccaccactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctca

SEQ ID NO: 218 - protein, 453 aa, Artificial Sequence
  source: /note="Description of Artificial Sequence: Synthetic polypeptide"
QVQLVQSGAELKQPGQSVKISCKASGYTFHHYGMNWVKQAPGQGLKWMGWINTDTGNPTYADDFKGRFVFSLDTSVSTAYLQISNLKNEDTATYYCVRYGTLYSGYGFFFDSWGQGTLVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 219 - DNA, 1359 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttccaccactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctcagccaagaccaccgcccccagcgtgtaccccctggcccccgtgtgcggcgataccaccggcagcagcgtgaccctgggctgcctggtgaagggctacttccccgagcccgtgaccctgacctggaacagcggctccctgagcagcggcgtgcacaccttccccgccgtgctgcagagcgacctgtacaccctgtccagctccgtgaccgtgacaagcagcacctggcccagccagagcatcacctgcaacgtggcccaccccgccagcagcaccaaggtggacaagaagatcgagcccaggggccccaccatcaagccctgccccccctgcaagtgcccagcccccaacctgctgggcggacccagcgtgttcatcttcccccccaagatcaaggacgtgctgatgatcagcctgagccccatcgtgacctgcgtggtggtggacgtgagcgaggacgaccccgacgtgcagatcagctggttcgtgaacaacgtggaggtgcacaccgcccagacccagacccaccgggaggactacaacagcaccctgcgcgtcgtgtccgccctgcccatccagcaccaggactggatgagcggcaaagaattcaagtgcaaggtgaacaacaaggacctgcctgcccccatcgagcggaccatcagcaagcccaagggcagcgtgagagccccccaggtgtacgtgctgccccctcccgaggaagagatgaccaagaaacaggtgacactgacctgcatggtgaccgacttcatgcccgaggacatctacgtggagtggaccaacaacggcaagaccgagctgaactacaagaacaccgagcctgtgctggacagcgacggcagctacttcatgtacagcaagctgcgggtggagaagaaaaactgggtggagcggaacagctacagctgcagcgtggtgcacgagggcctgcacaaccaccacaccaccaagagcttcagccggacccccggcaag

SEQ ID NO: 220 - protein, 16 aa, Artificial Sequence
  source: /note="Description of Artificial Sequence: Synthetic peptide"
YISYDGDNNYNPSLKN

SEQ ID NO: 221 - protein, 15 aa, Artificial Sequence
  source: /note="Description of Artificial Sequence: Synthetic peptide"
GYYRYGLSYYYVMDY

SEQ ID NO: 222 - protein, 5 aa, Artificial Sequence
  source: /note="Description of Artificial Sequence: Synthetic peptide"
SYDGD

SEQ ID NO: 223 - protein, 7 aa, Artificial Sequence
  source: /note="Description of Artificial Sequence: Synthetic peptide"
ISYDGDN

SEQ ID NO: 224 - protein, 17 aa, Artificial Sequence
  source: /note="Description of Artificial Sequence: Synthetic peptide"
AGGYYRYGLSYYYVMDY

SEQ ID NO: 225 - protein, 124 aa, Artificial Sequence
  source: /note="Description of Artificial Sequence: Synthetic polypeptide"
DIQLQESGPGLVKPSQSLSLTCSVTGYSITSGYYWNWIRQFPGNKLEWMGYISYDGDNNYNPSLKNRISITRDTSKNQFFLKLSSVTTEDTATYYCAGGYYRYGLSYYYVMDYWGQGTSVTVSS

SEQ ID NO: 226 - DNA, 372 bp, Artificial Sequence
  source: /note="Description of Artificial Sequence: Synthetic polynucleotide"
gatatacagcttcaggagtcaggacctggcctcgtgaaaccttctcagtctctgtctctcacctgctctgtcactggctactccatcaccagtggttattactggaactggatccggcagtttccaggaaacaaactggaatggatgggctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgtcgtattactatgttatggactactggggtcaaggaacctcagtcaccgtctcctca

SEQ ID NO: 227 - protein, 454 aa, Artificial Sequence
  source: /note="Description of Artificial Sequence: Synthetic polypeptide"
DIQLQESGPGLVKPSQSLSLTCSVTGYSITSGYYWNWIRQFPGNKLEWMGYISYDGDNNYNPSLKNRISITRDTSKNQFFLKLSSVTTEDTATYYCAGGYYRYGLSYYYVMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 228 - DNA, 1362 bp, Artificial Sequence
  source: /note="Description of Artificial Sequence: Synthetic polynucleotide"
gatatacagcttcaggagtcaggacctggcctcgtgaaaccttctcagtctctgtctctcacctgctctgtcactggctactccatcaccagtggttattactggaactggatccggcagtttccaggaaacaaactggaatggatgggctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgtcgtattactatgttatggactactggggtcaaggaacctcagtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 229 - protein, 111 aa, Artificial Sequence
  source: /note="Description of Artificial Sequence: Synthetic polypeptide"
DTVLTQSPASLAVSLGQRATISCKASQSVDYDGNSYMNWYQQKPGQPPKLLIYAASNLESGIPARFSGSGSGTDFTLNIHPVEEEDAATYYCQQSNEDPPTFGGGTKLEIK

SEQ ID NO: 230 - DNA, 333 bp, Artificial Sequence
  source: /note="Description of Artificial Sequence: Synthetic polynucleotide"
gacactgtgctgacccaatctccagcctctttggctgtgtctctagggcagagggccaccatctcctgcaaggccagccaaagtgttgattatgatggtaatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatcctccgacgttcggtggaggcaccaagctggaaatcaaa

SEQ ID NO: 231 - protein, 218 aa, Artificial Sequence
  source: /note="Description of Artificial Sequence: Synthetic polypeptide"
DTVLTQSPASLAVSLGQRATISCKASQSVDYDGNSYMNWYQQKPGQPPKLLIYAASNLESGIPARFSGSGSGTDFTLNIHPVEEEDAATYYCQQSNEDPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 232 - DNA, 654 bp, Artificial Sequence
  source: /note="Description of Artificial Sequence: Synthetic polynucleotide"
gacactgtgctgacccaatctccagcctctttggctgtgtctctagggcagagggccaccatctcctgcaaggccagccaaagtgttgattatgatggtaatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatcctccgacgttcggtggaggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 233 - protein, 125 aa, Artificial Sequence
  source: /note="Description of Artificial Sequence: Synthetic polypeptide"
EVQLQQFGAELVKPGASVKISCKASGYTFTDYNMDWVKQSHGKSLEWIGDINPKYDISTYNQQFKGKATLTVDKSSSTAYMELRSLTSEDTAVYYCARRGFFLYYGINYYYFDVWGAGTTVTVSS

SEQ ID NO: 234 - DNA, 375 bp, Artificial Sequence
  source: /note="Description of Artificial Sequence: Synthetic polynucleotide"
gaggtccaactgcaacagtttggagctgaactggtgaagcctggggcttcagtgaagatatcctgcaaggcttctggctacacattcactgactacaacatggactgggtgaagcagagccatggaaagagccttgagtggattggagatattaatcctaagtatgatatttctacctacaatcagcaattcaagggaaaggccacattgactgtagacaagtcctccagcacagcctacatggagctccgcagcctgacatctgaggacactgcagtctattattgtgcaagaagaggcttttttctttactacggtattaactactattacttcgatgtctggggcgcagggaccacggtcaccgtctcctca

SEQ ID NO: 235 - protein, 455 aa, Artificial Sequence
  source: /note="Description of Artificial Sequence: Synthetic polypeptide"
EVQLQQFGAELVKPGASVKISCKASGYTFTDYNMDWVKQSHGKSLEWIGDINPKYDISTYNQQFKGKATLTVDKSSSTAYMELRSLTSEDTAVYYCARRGFFLYYGINYYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - DNA, 1365 bp, Artificial Sequence
  source: /note="Description of Artificial Sequence: Synthetic polynucleotide"
gaggtccaactgcaacagtttggagctgaactggtgaagcctggggcttcagtgaagatatcctgcaaggcttctggctacacattcactgactacaacatggactgggtgaagcagagccatggaaagagccttgagtggattggagatattaatcctaagtatgatatttctacctacaatcagcaattcaagggaaaggccacattgactgtagacaagtcctccagcacagcctacatggagctccgcagcctgacatctgaggacactgcagtctattattgtgcaagaagaggcttttttctttactacggtattaactactattacttcgatgtctggggcgcagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 237 - protein, 106 aa, Artificial Sequence
  source: /note="Description of Artificial Sequence: Synthetic polypeptide"
QIVLTQSPAIMSASLGEEITLTCSASSSVSYIHWYQQKSGTSPTLLIYSTSNLASGVPSRFSGSGSGTFYSLTISSVEAEDAADYYCHQWSSYPWTFGGGTKLEIK

SEQ ID NO: 238 - DNA, 318 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatacactggtaccagcagaagtcaggcacttctcccacactcttgatttatagcacatccaatctggcttctggagtcccttctcgcttcagtggcagtgggtctgggaccttttattctctcacaatcagcagtgtggaggctgaagatgctgccgattattactgccatcagtggagtagttatccatggacgttcggtggaggcaccaagctggaaatcaaa

SEQ ID NO: 239 - protein, 213 aa, Artificial Sequence
  source: /note="Description of Artificial Sequence: Synthetic polypeptide"
QIVLTQSPAIMSASLGEEITLTCSASSSVSYIHWYQQKSGTSPTLLIYSTSNLASGVPSRFSGSGSGTFYSLTISSVEAEDAADYYCHQWSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 240 - DNA, 639 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatacactggtaccagcagaagtcaggcacttctcccacactcttgatttatagcacatccaatctggcttctggagtcccttctcgcttcagtggcagtgggtctgggaccttttattctctcacaatcagcagtgtggaggctgaagatgctgccgattattactgccatcagtggagtagttatccatggacgttcggtggaggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 241 - protein, 129 aa, Artificial Sequence
  source: /note="Description of Artificial Sequence: Synthetic polypeptide"
DIQLQESGPGLVKPSQSLSLTCSVTGYSITSGYYWNWIRQFPGNKLEWMGYISYDGDNNYNPSLKNRISITRDTSKNQFFLKLSSVTTEDTATYYCAGGYYRYGLGSYSGSYYYVMDYWGQGTSVTVSS

SEQ ID NO: 242 - DNA, 387 bp, Artificial Sequence
  source: /note="Description of Artificial Sequence: Synthetic polynucleotide"
gatatacagcttcaggagtcaggacctggcctcgtgaaaccttctcagtctctgtctctcacctgctctgtcactggctactccatcaccagtggttattactggaactggatccggcagtttccaggaaacaaactggaatggatgggctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgggctcctactccggctcgtattactatgttatggactactggggtcaaggaacctcagtcaccgtctcctca

SEQ ID NO: 243 - protein, 459 aa, Artificial Sequence
  source: /note="Description of Artificial Sequence: Synthetic polypeptide"
DIQLQESGPGLVKPSQSLSLTCSVTGYSITSGYYWNWIRQFPGNKLEWMGYISYDGDNNYNPSLKNRISITRDTSKNQFFLKLSSVTTEDTATYYCAGGYYRYGLGSYSGSYYYVMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - DNA, 1377 bp, Artificial Sequence
  source: /note="Description of Artificial Sequence: Synthetic polynucleotide"
gatatacagcttcaggagtcaggacctggcctcgtgaaaccttctcagtctctgtctctcacctgctctgtcactggctactccatcaccagtggttattactggaactggatccggcagtttccaggaaacaaactggaatggatgggctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgggctcctactccggctcgtattactatgttatggactactggggtcaaggaacctcagtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 245 - protein, 17 aa, Artificial Sequence
  source: /note="Description of Artificial Sequence: Synthetic peptide"
DINPNYDITTYNQRFKG

SEQ ID NO: 246 - protein, 16 aa, Artificial Sequence
  source: /note="Description of Artificial Sequence: Synthetic peptide"
RGFFPYYGNSYYYFDV

SEQ ID NO: 247 - protein, 6 aa, Artificial Sequence
  source: /note="Description of Artificial Sequence: Synthetic peptide"
NPNYDI

SEQ ID NO: 248 - protein, 8 aa, Artificial Sequence
  source: /note="Description of Artificial Sequence: Synthetic peptide"
INPNYDIT

SEQ ID NO: 249 - protein, 18 aa, Artificial Sequence
  source: /note="Description of Artificial Sequence: Synthetic peptide"
ARRGFFPYYGNSYYYFDV

SEQ ID NO: 250 - protein, 125 aa, Artificial Sequence
  source: /note="Description of Artificial Sequence: Synthetic polypeptide"
EVQLQQFGAELVKPGTSVKISCKASGYTFTDYNMDWVKQSHGKSLEWIGDINPNYDITTYNQRFKGKATLTVDKSSSTAYMELRSLTSEDTAVYYCARRGFFPYYGNSYYYFDVWGAGTTVTVSS

SEQ ID NO: 251 - DNA, 375 bp, Artificial Sequence
  source: /note="Description of Artificial Sequence: Synthetic polynucleotide"
gaggtccagctgcaacagtttggagctgagctggtgaagcctgggacttcagtgaagatatcctgcaaggcttctggctacacattcactgactacaacatggactgggtgaagcagagccatggaaagagccttgagtggattggagatattaatcctaactatgatattactacctacaaccagaggttcaagggaaaggccacattgactgtagacaagtcctccagcacagcctacatggagctccgcagcctgacatctgaggacactgcagtctattactgtgcaagaagaggattttttccttattacggtaatagctactattacttcgatgtctggggcgcagggaccacggtcaccgtctcctca

SEQ ID NO: 252 - protein, 455 aa, Artificial Sequence
  source: /note="Description of Artificial Sequence: Synthetic polypeptide"
EVQLQQFGAELVKPGTSVKISCKASGYTFTDYNMDWVKQSHGKSLEWIGDINPNYDITTYNQRFKGKATLTVDKSSSTAYMELRSLTSEDTAVYYCARRGFFPYYGNSYYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - DNA, 1365 bp, Artificial Sequence
  source: /note="Description of Artificial Sequence: Synthetic polynucleotide"
gaggtccagctgcaacagtttggagctgagctggtgaagcctgggacttcagtgaagatatcctgcaaggcttctggctacacattcactgactacaacatggactgggtgaagcagagccatggaaagagccttgagtggattggagatattaatcctaactatgatattactacctacaaccagaggttcaagggaaaggccacattgactgtagacaagtcctccagcacagcctacatggagctccgcagcctgacatctgaggacactgcagtctattactgtgcaagaagaggattttttccttattacggtaatagctactattacttcgatgtctggggcgcagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 254 - protein, 10 aa, Artificial Sequence
  source: /note="Description of Artificial Sequence: Synthetic peptide"
SASSSVSYMH

SEQ ID NO: 255 - protein, 9 aa, Artificial Sequence
  source: /note="Description of Artificial Sequence: Synthetic peptide"
HQWSNYPWT

SEQ ID NO: 256 - protein, 6 aa, Artificial Sequence
  source: /note="Description of Artificial Sequence: Synthetic peptide"
WSNYPW

SEQ ID NO: 257 - protein, 106 aa, Artificial Sequence
  source: /note="Description of Artificial Sequence: Synthetic polypeptide"
QIVLTQSPTIMSASLGEEITLTCSASSSVSYMHWYQQKSGTSPKLLIYSTSNLASGVPSRFSGSGSGTFYSLTISSVEAEDAADYYCHQWSNYPWTFGGGTKLEIK

SEQ ID NO: 258 - DNA, 318 bp, Artificial Sequence
  source: /note="Description of Artificial Sequence: Synthetic polynucleotide"
caaattgttctcacccagtctccaacaatcatgtctgcatctctaggggaggagatcacccttacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtaattatccatggacgttcggtggaggcaccaagctggaaatcaaa

SEQ ID NO: 259 - protein, 213 aa, Artificial Sequence
  source: /note="Description of Artificial Sequence: Synthetic polypeptide"
QIVLTQSPTIMSASLGEEITLTCSASSSVSYMHWYQQKSGTSPKLLIYSTSNLASGVPSRFSGSGSGTFYSLTISSVEAEDAADYYCHQWSNYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - DNA, 639 bp, Artificial Sequence
  source: /note="Description of Artificial Sequence: Synthetic polynucleotide"
caaattgttctcacccagtctccaacaatcatgtctgcatctctaggggaggagatcacccttacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtaattatccatggacgttcggtggaggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 261 - protein, 17 aa, Artificial Sequence
  source: /note="Description of Artificial Sequence: Synthetic peptide"
DINPNYDITSYNQKFKG

SEQ ID NO: 262 - protein, 16 aa, Artificial Sequence
  source: /note="Description of Artificial Sequence: Synthetic peptide"
RGFFLYYGSSYYYFDV

SEQ ID NO: 263 - protein, 18 aa, Artificial Sequence
  source: /note="Description of Artificial Sequence: Synthetic peptide"
ARRGFFLYYGSSYYYFDV

SEQ ID NO: 264 - protein, 125 aa, Artificial Sequence
  source: /note="Description of Artificial Sequence: Synthetic polypeptide"
EVQLQQFGAELVKPGASVKISCKASGYTFTDYNMDWVKQSHGKSLEWIGDINPNYDITSYNQKFKGKATLTVDKSSSTAYMELRSLTSEDTAVYYCARRGFFLYYGSSYYYFDVWGAGTTVTVSS

SEQ ID NO: 265 - DNA, 375 bp, Artificial Sequence
  source: /note="Description of Artificial Sequence: Synthetic polynucleotide"
gaggtccagctgcaacagtttggagctgagctggtgaagcctggggcttcagtgaagatatcctgcaaggcttctggctacacattcactgactacaacatggactgggtgaagcagagccatggaaagagccttgagtggattggagatattaatcctaactatgatattactagctacaaccagaagttcaagggaaaggccacattgactgtagacaagtcctccagcacagcctacatggagctccgcagcctgacatctgaggacactgcagtctattactgtgcaagaagagggttttttctttactacggtagtagctactattacttcgatgtctggggcgcagggaccacggtcaccgtctcctca

SEQ ID NO: 266 - protein, 455 aa, Artificial Sequence
  source: /note="Description of Artificial Sequence: Synthetic polypeptide"
EVQLQQFGAELVKPGASVKISCKASGYTFTDYNMDWVKQSHGKSLEWIGDINPNYDITSYNQKFKGKATLTVDKSSSTAYMELRSLTSEDTAVYYCARRGFFLYYGSSYYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 267 - DNA, 1365 bp, Artificial Sequence
  source: /note="Description of Artificial Sequence: Synthetic polynucleotide"
gaggtccagctgcaacagtttggagctgagctggtgaagcctggggcttcagtgaagatatcctgcaaggcttctggctacacattcactgactacaacatggactgggtgaagcagagccatggaaagagccttgagtggattggagatattaatcctaactatgatattactagctacaaccagaagttcaagggaaaggccacattgactgtagacaagtcctccagcacagcctacatggagctccgcagcctgacatctgaggacactgcagtctattactgtgcaagaagagggttttttctttactacggtagtagctactattacttcgatgtctggggcgcagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 268 - protein, 106 aa, Artificial Sequence
  source: /note="Description of Artificial Sequence: Synthetic polypeptide"
QIVLTQSPAIMSASLGEEITLTCSASSSVSYMHWYQQKSGTSPKLLIYSTSNLASGVPSRFSGSGSGTFYSLTISSVEAEDAADYYCHQWSSYPWTFGGGTKLEIK

SEQ ID NO: 269 - DNA, 318 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtagttatccatggacgttcggtggaggcaccaagctggaaatcaaa

SEQ ID NO: 270 - protein, 213 aa, Artificial Sequence
  source: /note="Description of Artificial Sequence: Synthetic polypeptide"
QIVLTQSPAIMSASLGEEITLTCSASSSVSYMHWYQQKSGTSPKLLIYSTSNLASGVPSRFSGSGSGTFYSLTISSVEAEDAADYYCHQWSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - DNA, 639 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatgcactggtaccagcagaagtcaggcacttctcccaaactcttgatttatagcacatccaacctggcttctggagtcccttctcgcttcagtggcagtgggtctgggaccttttattctctcacaatcagcagtgtggaggctgaagatgctgccgattattactgccatcagtggagtagttatccatggacgttcggtggaggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 272 - protein, 5 aa, Artificial Sequence
  source: /note="Description of Artificial Sequence: Synthetic peptide"
EYTMH

SEQ ID NO: 273 - protein, 17 aa, Artificial Sequence
  source: /note="Description of Artificial Sequence: Synthetic peptide"
GINPNNGITTYNQKFKG

SEQ ID NO: 274 - protein, 17 aa, Artificial Sequence
  source: /note="Description of Artificial Sequence: Synthetic peptide"
RGFPIYYYGTSLYYFDY

SEQ ID NO: 275 - protein, 7 aa, Artificial Sequence
  source: /note="Description of Artificial Sequence: Synthetic peptide"
GYTFTEY

SEQ ID NO: 276 - protein, 6 aa, Artificial Sequence
  source: /note="Description of Artificial Sequence: Synthetic peptide"
NPNNGI

SEQ ID NO: 277 - protein, 10 aa, Artificial Sequence
  source: /note="Description of Artificial Sequence: Synthetic peptide"
GYTFTEYTMH

SEQ ID NO: 278 - protein, 8 aa, Artificial Sequence
  source: /note="Description of Artificial Sequence: Synthetic peptide"
GYTFTEYT

SEQ ID NO: 279 - protein, 8 aa, Artificial Sequence
  source: /note="Description of Artificial Sequence: Synthetic peptide"
INPNNGIT

SEQ ID NO: 280 - protein, 19 aa, Artificial Sequence
  source: /note="Description of Artificial Sequence: Synthetic peptide"
ARRGFPIYYYGTSLYYFDY

SEQ ID NO: 281 - protein, 126 aa, Artificial Sequence
  source: /note="Description of Artificial Sequence: Synthetic polypeptide"
EVQLQQSGPELVKPGASVKISCKTSGYTFTEYTMHWVKQSHGKSLEWIGGINPNNGITTYNQKFKGKATLTVDKSSSTAYMDLRSLTSEGSAVYYCARRGFPIYYYGTSLYYFDYWGQGTTLTVSS

SEQ ID NO: 282 - DNA, 378 bp, Artificial Sequence
  source: /note="Description of Artificial Sequence: Synthetic polynucleotide"
gaggtccagctgcaacagtctggacctgagctggtgaagcctggggcttcagtgaagatatcctgcaagacttctggatacacattcactgaatacaccatgcactgggtgaagcagagccatggaaagagccttgagtggattggaggtattaatcctaacaatggtattactacttacaaccagaagttcaagggcaaggccacattgactgtagacaagtcctccagcacagcctacatggacctccgcagcctgacatctgagggttctgcagtctattactgtgcaagaaggggattccctatttattactacggtactagcctctactactttgactactggggccaaggcaccactctcacagtctcctca

SEQ ID NO: 283 - protein, 456 aa, Artificial Sequence
  source: /note="Description of Artificial Sequence: Synthetic polypeptide"
EVQLQQSGPELVKPGASVKISCKTSGYTFTEYTMHWVKQSHGKSLEWIGGINPNNGITTYNQKFKGKATLTVDKSSSTAYMDLRSLTSEGSAVYYCARRGFPIYYYGTSLYYFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 284 - DNA, 1368 bp, Artificial Sequence
  source: /note="Description of Artificial Sequence: Synthetic polynucleotide"
gaggtccagctgcaacagtctggacctgagctggtgaagcctggggcttcagtgaagatatcctgcaagacttctggatacacattcactgaatacaccatgcactgggtgaagcagagccatggaaagagccttgagtggattggaggtattaatcctaacaatggtattactacttacaaccagaagttcaagggcaaggccacattgactgtagacaagtcctccagcacagcctacatggacctccgcagcctgacatctgagggttctgcagtctattactgtgcaagaaggggattccctatttattactacggtactagcctctactactttgactactggggccaaggcaccactctcacagtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 285 - protein, 7 aa, Artificial Sequence
  source: /note="Description of Artificial Sequence: Synthetic peptide"
TTSNLAS

SEQ ID NO: 286 - protein, 3 aa, Artificial Sequence
  source: /note="Description of Artificial Sequence: Synthetic peptide"
TTS

SEQ ID NO: 287 - protein, 106 aa, Artificial Sequence
  source: /note="Description of Artificial Sequence: Synthetic polypeptide"
QIVLTQSPAIMSASLGEEITLTCSASSSVSYMHWYQQRSGTSPKLLIYTTSNLASGVPSRFSGSGSGTFYSLTISSVEAEDAADYYCHQWSSYPWTFGGGTKLEIK

SEQ ID NO: 288 - DNA, 318 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatgcactggtaccagcagaggtcaggcacttctcccaaactcttgatttataccacatccaacctggcttctggagtcccttctcgcttcagtggcagtgggtctgggaccttttattctctcacaatcagcagtgtggaggctgaagatgctgccgattattactgccatcagtggagtagttatccgtggacgttcggtggaggcaccaagctggaaatcaaa

SEQ ID NO: 289 - protein, 213 aa, Artificial Sequence
  source: /note="Description of Artificial Sequence: Synthetic polypeptide"
QIVLTQSPAIMSASLGEEITLTCSASSSVSYMHWYQQRSGTSPKLLIYTTSNLASGVPSRFSGSGSGTFYSLTISSVEAEDAADYYCHQWSSYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - DNA, 639 bp, Artificial Sequence
  source: /note="Description of Artificial Sequence: Synthetic polynucleotide"
caaattgttctcacccagtctccagcaatcatgtctgcatctctaggggaggagatcaccctaacctgcagtgccagctcgagtgtaagttacatgcactggtaccagcagaggtcaggcacttctcccaaactcttgatttataccacatccaacctggcttctggagtcccttctcgcttcagtggcagtgggtctgggaccttttattctctcacaatcagcagtgtggaggctgaagatgctgccgattattactgccatcagtggagtagttatccgtggacgttcggtggaggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 291 - protein, 495 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 292 - DNA, 2156 bp, Homo sapiens
ggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaaaaaaaaaaaaaaaaaaaaaaaaaaaaaaaaaaaaaaaaaaaaaaaaaaaaaaaaa

SEQ ID NO: 293 - protein, 472 aa, Homo sapiens
MAGKVRSLLPPLLLAAAGLAGLLLLCVPTRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFYTVDFLRTSMGLPVATLQQLEAAAVNVCNQTWAQQLLSRGYGFDERAFGGVIFQKKAADTAVGWALGYMLNLTNLIPADPPGLRKGTDFSSWVVLLLLFASALLAALVLLLRQVHSAKLPSTI

SEQ ID NO: 294 - DNA, 2087 bp, Homo sapiens
ggctccccgcactctccgggtccacgcatcgtcctcccgcgcgcccgcccgcccatggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatttaggggccgacgggggcagctgccccatccctcccccaacccctgtatccccaccccgtactcccacccctcccacaacccctgtacctcccacccctgtatccccacccctccacccacccctctcccaacctctctccccgcccctgtatcctgcattcctccacccaccctctatcccccaccgctccaccccaccactgtcttctccatccttccaccccaccctcagcgtctctgcccctaaggcagcccaggaaataggaactgagactctggtacccacaggagcctgggtgggcaaagagcgctcaatccagctccttgaacccctccagcccgcttcagcctgggcatcactgcaggccccgtgctcctcctcctcctcctcagggctgggtctccagagagtggggccttggtcctgagaatcagcccttagaggctccttctgtgtagtctgggtctgtactggggagggtcacagcccacgggctggcagccagcccagcacctacttgtaaaaattttgtaataaaaagtttttcctagagacgtgaaaaaaaaaaaaaaaaaaaaaaaaaaaaaaaaaaaaaaaaaaaaaaaaaaaaaaaaaa

SEQ ID NO: 295 - protein, 117 aa, Artificial Sequence
  source: /note="Description of Artificial Sequence: Synthetic polypeptide"
EVQLLESGGGLVQPGGSLRLSCAASGFTFSSYAYSWVRQAPGKGLEWVSAISGSGGRTYYADSVKGRFTISRDNSKNTLYLQMNSLRAEDTAVYYCARLGYGRVDEWGRGTLVTVSS

SEQ ID NO: 296 - protein, 110 aa, Artificial Sequence
  source: /note="Description of Artificial Sequence: Synthetic polypeptide"
QSVLTQPPSASGTPGQRVTISCSGSLSNIGRNPVNWYQQLPGTAPKLLIYLDNLRLSGVPDRFSGSKSGTSASLAISGLQSEDEADYYCATWDDSHPGWTFGGGTKLTVL

SEQ ID NO: 297 - protein, 447 aa, Artificial Sequence
  source: /note="Description of Artificial Sequence: Synthetic polypeptide"
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 298 - protein, 214 aa, Artificial Sequence
  source: /note="Description of Artificial Sequence: Synthetic polypeptide"
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 299 - protein, 121 aa, Artificial Sequence
  source: /note="Description of Artificial Sequence: Synthetic polypeptide"
QVQLVESGGGVVQPGRSLRLSCATSGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 300 - protein, 107 aa, Artificial Sequence
  source: /note="Description of Artificial Sequence: Synthetic polypeptide"
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 301 - protein, 214 aa, Artificial Sequence
  source: /note="Description of Artificial Sequence: Synthetic polypeptide"
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 302 - protein, 121 aa, Artificial Sequence; identical to SEQ ID NO: 299
  source: /note="Description of Artificial Sequence: Synthetic polypeptide"

SEQ ID NO: 303 - protein, 107 aa, Artificial Sequence
  source: /note="Description of Artificial Sequence: Synthetic polypeptide"
EIVLTQSPATLSLSPGERATLSCRASQGVSSYLAWYQQKPGQAPRLLIYDASNRATGIPARFSGSGPGTDFTLTISSLEPEDFAVYYCQQRSNWHLTFGGGTKVEIK

SEQ ID NO: 304 - protein, 121 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVILYDGSNKYYPDSVKGRFTISRDNSKNTLYLQMNSLRAEDTAVYYCARGGSSWYPDSFDIWGQGTMVTVSS

SEQ ID NO: 305 - protein, 107 aa, Artificial Sequence; identical to SEQ ID NO: 300
  source: /note="Description of Artificial Sequence: Synthetic polypeptide"

SEQ ID NO: 306 - protein, 121 aa, Artificial Sequence
  source: /note="Description of Artificial Sequence: Synthetic polypeptide"
QVQLVESGGGVVQPGRSLRLSCAASGFTFSNYGMHWVRQAPGKGLEWVAVIWYDESNKYYPDSVKGRFTISRDNSKNTLYLQMNSLRAEDTAVYYCARGGSSWYPDSFDIWGQGTMVTVSS

SEQ ID NO: 307 - protein, 107 aa, Artificial Sequence; identical to SEQ ID NO: 300
  source: /note="Description of Artificial Sequence: Synthetic polypeptide"

SEQ ID NO: 308 - protein, 122 aa, Artificial Sequence
  source: /note="Description of Artificial Sequence: Synthetic polypeptide"
EVQLVESGGGLVQPGRSLRLSCAASGFTFDDYAMHWVRQAPGKGLEWVSGISWNSGSIGYADSVKGRFTISRDNAKNSLYLQMNSLRAEDTALYYCVRSGSYNYYYYGMDVWGQGTTVTVSR

SEQ ID NO: 309 - protein, 111 aa, Artificial Sequence
  source: /note="Description of Artificial Sequence: Synthetic polypeptide"
QSVLTQPPSASGTPGQRVTISCSGSSSNIGSNTVNWYQQLPGTAPKLLIYSNNQRPSGVPDRFSGSKSGTSASLAISGLQSEDEADYYCAAWDDSLNGWVFGGGTKLTVLG

SEQ ID NO: 310 - protein, 121 aa, Artificial Sequence
  source: /note="Description of Artificial Sequence: Synthetic polypeptide"
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCARGLWEVRALPSVYWGQGTLVTVSS

SEQ ID NO: 311 - protein, 109 aa, Artificial Sequence
  source: /note="Description of Artificial Sequence: Synthetic polypeptide"
SYELTQPPSVSVAPGQTARITCGANDIGSKSVHWYQQKAGQAPVLVVSEDIIRPSGIPERISGSNSGNTATLTISRVEAGDEADYYCQVWDRDSDQYVFGTGTKVTVLG

SEQ ID NO: 312 - protein, 486 aa, Artificial Sequence
  source: /note="Description of Artificial Sequence: Synthetic polypeptide"
MALPVTALLLPLALLLHAARPDIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 313 - protein, 465 aa, Artificial Sequence
  source: /note="Description of Artificial Sequence: Synthetic polypeptide"
DIQMTQTTSSLSASLGDRVTISCRASQDISKYLNWYQQKPDGTVKLLIYHTSRLHSGVPSRFSGSGSGTDYSLTISNLEQEDIATYFCQQGNTLPYTFGGGTKLEITGGGGSGGGGSGGGGSEVKLQESGPGLVAPSQSLSVTCTVSGVSLPDYGVSWIRQPPRKGLEWLGVIWGSETTYYNSALKSRLTIIKDNSKSQVFLKMNSLQTDDTAIYYCAKHYYYGGSYAMDYWGQGTSVTVSSTTTPAPRPPTPAPTIASQPLSLRPEACRPAAGGAVHTRGLDFACDIYIWAPLAGTCGVLLLSLVITLYCKRGRKKLLYIFKQPFMRPVQTTQEEDGCSCRFPEEEEGGCELRVKFSRSADAPAYKQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 314 - protein, 449 aa, Artificial Sequence
  source: /note="Description of Artificial Sequence: Synthetic polypeptide"
QVQLQQSGAEVKKPGASVKVSCKASGYTFTDYYMKWVKQSHGKSLEWMGDIIPSNGATFYNQKFKGKATLTVDRSTSTAYMELSSLRSEDTAVYYCARSHLLRASWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 315 - protein, 485 aa, Artificial Sequence
  source: /note="Description of Artificial Sequence: Synthetic polypeptide"
EVQLVESGGGLVQPGGSLRLSCAASGFTFSTYAMNWVRQAPGKGLEWVGRIRSKYNNYATYYADSVKGRFTISRDDSKNTLYLQMNSLRAEDTAVYYCVRHGNFGDSYVSWFAYWGQGTLVTVSSGKPGSGKPGSGKPGSGKPGSQAVVTQEPSLTVSPGGTVTLTCGSSTGAVTTSNYANWVQQKPGKSPRGLIGGTNKRAPGVPARFSGSLLGGKAALTISGAQPEDEADYYCALWYSNHWVFGGGTKLTVLEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 316 - protein, 220 aa, Artificial Sequence
  source: /note="Description of Artificial Sequence: Synthetic polypeptide"
DFVMTQSPDSLAVSLGERATINCKSSQSLLNTGNQKNYLTWYQQKPGQPPKLLIYWASTRESGVPDRFTGSGSGTDFTLTISSLQAEDVAVYYCQNDYSYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 317 - protein, 450 aa, Artificial Sequence
  source: /note="Description of Artificial Sequence: Synthetic polypeptide"
QVQLVQSGAEVKKPGASVKVSCKASGYTFTSYNMHWVRQAPGQGLEWMGAIYPGNGDTSYNQKFQGRVTITADKSISTAYMELSSLRSEDTAVYYCARSTYYGGDWYFNVWGAGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 318 - protein, 485 aa, Artificial Sequence; identical to SEQ ID NO: 315
  source: /note="Description of Artificial Sequence: Synthetic polypeptide"

SEQ ID NO: 319 - protein, 213 aa, Artificial Sequence
  source: /note="Description of Artificial Sequence: Synthetic polypeptide"
QIVLTQSPSSLSASVGDRVTITCRASSSVSYIHWFQQKPGKSPKPLIYATSNLASGVPVRFSGSGSGTDYTLTISSLQPEDFATYYCQQWTSNPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 320-327 - skipped (8 entries)

SEQ ID NO: 328 - protein, 124 aa, Artificial Sequence
  source: /note="Description of Artificial Sequence: Synthetic polypeptide"
EVKLEQSGPGLVKPSQSLSLTCSVTGYSITSGYYWNWIRQFPGNKLEWMSYISYDGDNNYNPSLKNRISITRDTSKNQFFLKLSSVTTEDTATYYCAGGYYRYGLSYYYVMDYWGQGTSVTVSA

SEQ ID NO: 329 - DNA, 372 bp, Artificial Sequence
  source: /note="Description of Artificial Sequence: Synthetic polynucleotide"
gaagtgaagctggagcagtcaggacctggcctcgtgaaaccttctcagtctctgtctctcacctgctctgtcactggctactccatcaccagtggttattactggaactggatccggcagtttccaggaaacaaactggaatggatgagctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgtcgtattactatgttatggactactggggtcaaggaacctcagtcacagtctccgca

SEQ ID NO: 330 - protein, 227 aa, Artificial Sequence
  source: /note="Description of Artificial Sequence: Synthetic polypeptide"
EVKLEQSGPGLVKPSQSLSLTCSVTGYSITSGYYWNWIRQFPGNKLEWMSYISYDGDNNYNPSLKNRISITRDTSKNQFFLKLSSVTTEDTATYYCAGGYYRYGLSYYYVMDYWGQGTSVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 331 - DNA, 681 bp, Artificial Sequence
  source: /note="Description of Artificial Sequence: Synthetic polynucleotide"
gaagtgaagctggagcagtcaggacctggcctcgtgaaaccttctcagtctctgtctctcacctgctctgtcactggctactccatcaccagtggttattactggaactggatccggcagtttccaggaaacaaactggaatggatgagctacataagctacgacggtgacaataactacaacccatctctcaaaaatcgaatctccatcactcgtgacacatctaagaaccagtttttcctgaagttgagttctgtgactactgaggacacagctacatattactgtgcaggaggctactataggtacggcctgtcgtattactatgttatggactactggggtcaaggaacctcagtcacagtctccgcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgc

SEQ ID NO: 332 - protein, 111 aa, Artificial Sequence
  source: /note="Description of Artificial Sequence: Synthetic polypeptide"
DIKMTQSPASLAVSLGQRATISCKASQSVDYDGNSYMNWYQQKPGQPPKLLIYAASNLESGIPARFSGSGSGTDFTLNIHPVEEEDAATYYCQQSNEDPPTFGGGTKLELK

SEQ ID NO: 333 - DNA, 333 bp, Artificial Sequence
  source: /note="Description of Artificial Sequence: Synthetic polynucleotide"
gatattaagatgacccaatctccagcctctttggctgtgtctctagggcagagggccaccatctcctgcaaggccagccaaagtgttgattatgatggtaatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatcctccgacgttcggtggaggcaccaagctggaactcaaa

SEQ ID NO: 334 - protein, 218 aa, Artificial Sequence
  source: /note="Description of Artificial Sequence: Synthetic polypeptide"
DIKMTQSPASLAVSLGQRATISCKASQSVDYDGNSYMNWYQQKPGQPPKLLIYAASNLESGIPARFSGSGSGTDFTLNIHPVEEEDAATYYCQQSNEDPPTFGGGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 335 - DNA, 654 bp, Artificial Sequence
  source: /note="Description of Artificial Sequence: Synthetic polynucleotide"
gatattaagatgacccaatctccagcctctttggctgtgtctctagggcagagggccaccatctcctgcaaggccagccaaagtgttgattatgatggtaatagttatatgaactggtaccaacagaaaccaggacagccacccaaactcctcatctatgctgcatccaatctagaatctgggatcccagccaggtttagtggcagtgggtctgggacagacttcaccctcaacatccatcctgtggaggaggaggatgctgcaacctattactgtcagcaaagtaatgaggatcctccgacgttcggtggaggcaccaagctggaactcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 336 - protein, 228 aa, Artificial Sequence
  source: /note="Description of Artificial Sequence: Synthetic polypeptide"
EVQLQQFGAELVKPGASVKISCKASGYTFTDYNMDWVKQSHGKSLEWIGDINPKYDISTYNQQFKGKATLTVDKSSSTAYMELRSLTSEDTAVYYCARRGFFLYYGINYYYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 337 - DNA, 684 bp, Artificial Sequence
  source: /note="Description of Artificial Sequence: Synthetic polynucleotide"
gaggtccaactgcaacagtttggagctgaactggtgaagcctggggcttcagtgaagatatcctgcaaggcttctggctacacattcactgactacaacatggactgggtgaagcagagccatggaaagagccttgagtggattggagatattaatcctaagtatgatatttctacctacaatcagcaattcaagggaaaggccacattgactgtagacaagtcctccagcacagcctacatggagctccgcagcctgacatctgaggacactgcagtctattattgtgcaagaagaggcttttttctttactacggtattaactactattacttcgatgtctggggcgcagggaccacggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgc

SEQ ID NO: 338 - protein, 226 aa, Artificial Sequence
  source: /note="Description of Artificial Sequence: Synthetic polypeptide"
QVQLVQSGAELKQPGQSVKISCKASGYTFTHYGMNWVKQAPGQGLKWMGWINTDTGNPTYADDFKGRFVFSLDTSVSTAYLQISNLKNEDTATYYCVRYGTLYSGYGFFFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 339 - DNA, 678 bp, Artificial Sequence
  source: /note="Description of Artificial Sequence: Synthetic polynucleotide"
caggtccagctggtgcagtcaggagctgagctgaagcagcctggacagtcggtgaagatctcctgcaaggcttcagggtacaccttcacacactatgggatgaactgggtgaagcaggcaccaggacagggtctaaagtggatgggctggatcaacactgacactgggaatccaacatatgctgatgacttcaaaggacggtttgtcttctccttggacacctctgtcagcactgcatatctgcagatcagcaacctcaagaatgaagacacggccacgtattactgtgtgagatatggaaccctatatagcggatatgggtttttttttgattcctggggccaagggaccctggtcaccgtctcctcagctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgc

SEQ ID NO: 340 - protein, 220 aa, Artificial Sequence
  source: /note="Description of Artificial Sequence: Synthetic polypeptide"
DIMMTQSPSSLSVSAGEKATITCKSSQSLFNSNTNKNYLNWYLQKPGQSPKLLFYYASTRHTGVPDRFIGSGSGTDFTLTITSVQDEDLADYYCQQWYSYPWTFGPGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 341 - DNA, 660 bp, Artificial Sequence
  source: /note="Description of Artificial Sequence: Synthetic polynucleotide"
gacatcatgatgacccagtctccatcatccctgagtgtgtcagcaggagagaaagccactatcacctgcaagtccagtcagagtcttttcaacagtaacaccaacaagaactacttgaactggtacctgcagaaaccagggcagtctcctaaactgctgttctattatgcatccactaggcatactggggtccctgatcgcttcataggcagtggatctgggacagatttcactctcaccatcaccagtgtccaggatgaagacctggcagattattactgtcagcagtggtatagctacccgtggacgttcggacctggcaccaagctggaaatcaaacgtacggtggccgctcccagcgtgttcatcttcccccccagcgacgagcagctgaagagtggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 342 - DNA, 1485 bp, Homo sapiens
atggccgggaaggtgcggtcactgctgccgccgctgctgctggccgccgcgggcctcgccggcctcctactgctgtgcgtccccacccgcgacgtccgggagccgcccgccctcaagtatggcatcgtcctggacgctggttcttcacacacgtccatgtttatctacaagtggccggcagacaaggagaacgacacaggcattgtgggccagcacagctcctgtgatgttccaggtgggggcatctccagctatgcagacaacccttctggggccagccagagtcttgttggatgcctcgaacaggcgcttcaggatgtgcccaaagagagacacgcgggcacacccctctacctgggagccacagcgggtatgcgcctgctcaacctgaccaatccagaggcctcgaccagtgtgctcatggcagtgactcacacactgacccagtacccctttgacttccggggtgcacgcatcctctcgggccaggaagagggggtgtttggctgggtgactgccaactacctgctggagaacttcatcaagtacggctgggtgggccggtggttccggccacggaaggggacactgggggccatggacctggggggtgcctctacccagatcacttttgagacaaccagtccagctgaggacagagccagcgaggtccagctgcatctctacggccagcactaccgagtctacacccacagcttcctctgctatggccgtgaccaggtcctccagaggctgctggccagcgccctccagacccacggcttccacccctgctggccgaggggcttttccacccaagtgctgctcggggatgtgtaccagtcaccatgcaccatggcccagcggccccagaacttcaacagcagtgccagggtcagcctgtcagggagcagtgacccccacctctgccgagatctggtttctgggctcttcagcttctcctcctgccccttctcccgatgctctttcaatggggtcttccagcccccagtggctgggaactttgtggccttctctgccttcttctacactgtggactttttgcggacttcgatggggctgcccgtggccaccctgcagcagctggaggcagccgcagtgaatgtctgcaaccagacctgggctcagctgcaagctcgggtgccagggcaacgggcccgcctggccgactactgcgccggggccatgttcgtgcagcagctgctgagtcgcggctacggcttcgacgagcgcgccttcggcggcgtgatcttccagaagaaggccgcggacactgcagtgggctgggcgctcggctacatgctgaacctgaccaacctgatccccgccgacccgccggggctgcgcaagggcacagacttcagctcctgggtcgtcctcctgctgctcttcgcctccgcgctcctggctgcgcttgtcctgctgctgcgtcaggtgcactccgccaagctgccaagcaccatt

SEQ ID NO: 343 - protein, 495 aa, Macaca fascicularis
MAGKVRSLLPPLLLAAAGLAGLLLLCVPTRDIREPPALKYGIVLDAGSSHTSMFIYKWPADKENDTGIVGQHSSCDVPGGGISSYADNPSGAGQSLVGCLEQALRDVPKERHAGTPLYLGATAGMRLLNLTNPEASTSVLTAVTHTLTQYPFDFRGARILSGQEEGVFGWVTANYLLENFIKYGWVGRWFRPRKGTLGAMDLGGASTQITFETTSPAEDRASEVQLRLYGQHYRVYTHSFLCYGRDQVLQRLLASALQTHSFHPCWPRGFSTHVLLGDVYQSPCTVAQRPQTFNSSARVSLSGSSDPHLCRDLVSGLFSFSSCPFSRCSFNGVFQPPVAGNFIAFSAFFYTVNFLRTSMGLPVATLQQLEAAAVNVCNQTWAQLQARVPGQQAHLADYCAGAMFVQQLLSRGYGFDERAFGGVIFQKKAADTAVGWALGYMLNLTNLIPADPPGLRKGTDFSSWVVLLLLFASALLAALVLLLHQVHSAKLPSTI

SEQ ID NO: 344 - DNA, 1485 bp, Macaca fascicularis
atggccgggaaggtgcggtcactgctgccgccgctgctgctggccgccgcgggcctcgccggcctcctactgctgtgcgtgcccaccagggacattagggagcctcccgctctgaaatacggcatcgtgctggacgccggaagcagccacacctccatgttcatctacaagtggcccgccgacaaggagaacgacacaggcatcgtgggccagcatagctcctgcgacgtgcctggaggcggcatctccagctacgccgacaatccttccggcgctggacagtccctggtgggatgtctggagcaggccctgagggacgtgcctaaggagagacacgccggcacccctctgtacctgggagccacagccggcatgagactcctgaatctgaccaaccctgaggcctccacctccgtcctgacagccgtgacacataccctgacccagtaccccttcgatttcaggggagccagaatactgagcggccaggaagaaggcgtgttcggatgggtgaccgccaactacctcctggagaacttcatcaagtacggctgggtgggcaggtggtttagacccaggaagggcaccctgggagctatggatctgggcggagcttccacacagatcaccttcgagaccacctcccccgctgaggacagagcctccgaggtgcagctgaggctgtacggccagcattacagggtgtatacacacagcttcctgtgctacggcagggaccaggtcctgcagagactgctcgcttccgccctgcagacccactccttccacccttgctggcctaggggctttagcacccatgtgctcctgggagatgtgtaccagagcccctgcaccgtggcccaaagaccccagacctttaactcctccgctagagtgagcctgagcggcagctccgatccccacctgtgtagggacctggtcagcggactgttcagcttcagcagctgccctttcagcaggtgcagcttcaatggcgtgttccagcctcccgtggccggcaacttcatcgctttctccgccttcttctacaccgtcaactttctgaggacaagcatgggactgcccgtggctaccctccaacaactggaggccgccgccgtgaacgtgtgcaaccagacatgggcccaactgcaggctagggtgcccggccaacaggcccatctggctgactactgtgccggcgccatgttcgtgcagcagctgctgagcaggggctatggattcgacgagagggccttcggcggcgtcatcttccaaaagaaggccgccgatacagccgtgggctgggctctgggctacatgctgaacctgacaaacctgatccccgctgacccccccggactgaggaagggaaccgatttcagcagctgggtcgtgctcctgctgctgtttgctagcgccctgctcgccgctctggtgctgctgctgcaccaggtgcactccgccaagctgcccagcaccatt

SEQ ID NO: 345 - protein, 495 aa, Mus musculus
MAGKLVSLVPPLLLAAVGLAGLLLLCVPTQDVREPPALKYGIVLDAGSSHTSMFVYKWPADKENDTGIVGQHSSCDVRGGGISSYANDPSRAGQSLVECLEQALRDVPKDRYASTPLYLGATAGMRLLNLTSPEATAKVLEAVTQTLTRYPFDFRGARILSGQDEGVFGWVTANYLLENFIKYGWVGRWIRPRKGTLGAMDLGGASTQITFETTSPSEDPDNEVHLRLYGQHYRVYTHSFLCYGRDQVLQRLLASALQIHRFHPCWPKGYSTQVLLREVYQSPCTMGQRPQTFNSSATVSLSGTSNAALCRDLVSGLFNISSCPFSQCSFNGVFQPPVAGNFIAFSAFYYTVDFLKTVMGLPVGTLKQLEDATETTCNQTWAELQARVPGQQTRLPDYCAVAMFIHQLLSRGYRFDERSFRGVVFEKKAADTAVGWALGYMLNLTNLIPADLPGLRKGTHFSSWVALLLLFTVLILAALVLLLRQVRSAKSPGAL

SEQ ID NO: 346 - DNA, 1485 bp, Mus musculus
atggctggaaagttggtgtcactggtgccacccctgctgctggctgccgtgggcctcgccggcctcctgctactgtgcgtccctacccaagacgtccgggagccgcccgccctcaagtatggcatcgttctggatgctggctcttcacacacatccatgtttgtctacaagtggccagcggacaaggaaaatgacacaggtatcgtgggccagcacagctcttgcgatgttcgaggtggtggcatctccagctacgcaaatgacccttctagggcaggccagagtctggttgaatgtcttgaacaggcacttcgggatgtgcccaaagacagatatgccagcactccactctacctgggagctacagcaggcatgcgcctactcaacctgaccagcccagaggccacagccaaggtgctggaggcagtgacacagacgctcacacggtacccctttgacttccgtggtgcccgcatcctctcgggacaggatgaaggggtgtttggctgggtgactgccaactacctgctggagaacttcatcaagtatggctgggtaggccggtggatacggccaaggaagggaactctgggggccatggaccttgggggtgcctcaacacagatcacctttgagacaaccagtccatctgaagatccagataatgaggtccatttgcggctctatggccagcattaccgtgtctacacccatagcttcctctgctatggccgggaccaggttctccagaggcttctggccagtgccctccagatccatcgcttccacccctgctggccaaagggctactccacccaagtgctgctccgggaagtctaccagtctccatgcactatgggtcagcgtccccagaccttcaacagcagtgccactgtcagcctgtcagggaccagcaacgctgccctctgtcgtgacctcgtctctgggctcttcaatatctcctcctgtcccttttcccaatgctccttcaatggggttttccagcctcccgtggctgggaacttcatagccttttctgctttctactatactgtagacttcctgaagacagtgatggggctgcctgtgggaaccctgaagcagctggaggatgccacagagaccacctgcaaccagacctgggctgagcttcaggcccgagtacccggacagcagacccgcctgcctgactactgcgctgtagccatgttcatacatcagctattgagccgcggttatcgcttcgacgagcgctctttccgtggagtggtcttcgaaaagaaggcggcagacacggctgtcggctgggcgctgggctacatgctgaatttgaccaacctgattcccgctgacctcccgggactacgtaagggcacccacttcagctcctgggttgctctcctgctgctcttcacagtcctgatcttggcggctttggtcctgctcttgcgccaggtgcgctctgccaagtccccaggcgccctc

SEQ ID NO: 347 - protein, 495 aa, Rattus norvegicus
MAGKLVSLVPPLLLAAAGLAGLLLLCVPTQDVREPPALKYGIVLDAGSSHTSMFVYKWPADKENDTGIVGQHSSCDVQGGGISSYANDPSKAGQSLVRCLEQALRDVPRDRHASTPLYLGATAGMRLLNLTSPEATARVLEAVTQTLTQYPFDFRGARILSGQDEGVFGWVTANYLLENFIKYGWVGRWIRPRKGTLGAMDLGGASTQITFETTSPSEDPGNEVHLRLYGQHYRVYTHSFLCYGRDQILLRLLASALQIHRFHPCWPKGYSTQVLLQEVYQSPCTMGQRPRAFNGSAIVSLSGTSNATLCRDLVSRLFNISSCPFSQCSFNGVFQPPVTGNFIAFSAFYYTVDFLTTVMGLPVGTLKQLEEATEITCNQTWTELQARVPGQKTRLADYCAVAMFIHQLLSRGYHFDERSFREVVFQKKAADTAVGWALGYMLNFTNLIPADLPGLRKGTHFSSWVALLLLFTVLILAALVLLLRQVRSAKSPGAL

SEQ ID NO: 348 - DNA, 1485 bp, Rattus norvegicus
atggctggaaagttggtgtcactggtgccacccctgctgctggctgccgcgggcctcgccggcctcctgctactgtgcgtccctacccaagacgtccgggagccgcccgccctcaagtatggcatcgttctggatgctggctcttcacacacatccatgtttgtctacaagtggccagcggacaaggaaaatgacacaggtatcgtgggccagcacagctcctgcgatgtgcagggcggcggcatttccagctatgccaacgacccctccaaagccggacagtccctggtcaggtgcctggagcaggccctgagagacgtccccagagacagacacgcgagcacccctctgtatctcggcgccacagccggcatgaggctgctgaacctgacctcccctgaggccacagccagagtcctggaggctgtcacccagaccctgacacagtaccccttcgactttaggggcgccagaatactgtccggccaggatgaaggcgtgttcggctgggtgacagccaactacctgctggagaactttattaagtacggctgggtgggcagatggatcaggcccaggaagggcaccctgggagccatggatctcggcggagcctccacccagatcacctttgagaccaccagcccctccgaagacccgggcaatgaggtccacctgaggctgtacggccagcactatagagtctacacccacagcttcctgtgctacggcagagatcaaatcctgctgagactgctcgcttccgccctgcagattcataggtttcacccctgctggcccaaaggctacagcacccaggtgctgctccaagaggtgtaccagagcccttgcaccatgggacagagacccagggctttcaacggaagcgccatcgtgtccctcagcggcaccagcaacgccaccctgtgtagggacctcgtgagcagactgttcaacatctcctcctgccctttcagccagtgttccttcaatggcgtgtttcagccccctgtgacaggcaacttcatcgccttcagcgctttctactacaccgtggactttctcacaaccgtcatgggcctgcccgtgggaaccctgaagcaactggaggaagccaccgagatcacctgcaaccagacctggaccgaactgcaagccagggtgcccggccagaagaccagactggccgactactgtgctgtcgccatgttcattcaccaactgctgagcaggggctaccacttcgatgaaaggagcttcagggaggtggtgttccagaagaaggccgccgataccgctgtgggctgggctctgggctacatgctcaacttcaccaacctgatccccgccgatctccccggactgaggaagggaacccacttcagctcctgggttgctctcctgctgctcttcacagtcctgatcttggcggctttggtcctgctcttgcgccaggtgcgctctgccaagtccccaggcgccctc

SEQ ID NO: 349 - protein, 510 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLCYGKDQALWQKLAKDIQVASNEILRDPCFHPGYKKVVNVSDLYKTPCTKRFEMTLPFQQFEIQGIGNYQQCHQSILELFNTSYCPYSQCAFNGIFLPPLQGDFGAFSAFYFVMKFLNLTSEKVSQEKVTEMMKKFCAQPWEEIKTSYAGVKEKYLSEYCFSGTYILSLLLQGYHFTADSWEHIHFIGKIQGSDAGWTLGYMLNLTNMIPAEQPLSTPLSHSTYVFLMVLFSLVLFTVAIIGLLIFHKPSYFWKDMV

SEQ ID NO: 350 - DNA, 1530 bp, Homo sapiens
atggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggta

SEQ ID NO: 351 - protein, 510 aa, Mus musculus
MEDIKDSKVKRFCSKNILIILGFTSILAVIALIAVGLTQNKPLPENVKYGIVLDAGSSHTNLYIYKWPAEKENDTGVVQQLEECQVKGPGISKYAQKTDEIGAYLAECMELSTELIPTSKHHQTPVYLGATAGMRLLRMESEQSADEVLAAVSTSLKSYPFDFQGAKIITGQEEGAYGWITINYLLGRFTQEQSWLSLISDSQKQETFGALDLGGASTQITFVPQNSTIESPENSLQFRLYGEDYTVYTHSFLCYGKDQALWQKLAKDIQVSSGGVLKDPCFNPGYEKVVNVSELYGTPCTKRFEKKLPFDQFRIQGTGDYEQCHQSILELFNNSHCPYSQCAFNGVFLPPLHGSFGAFSAFYFVMDFFKKVAKNSVISQEKMTEITKNFCSKSWEETKTSYPSVKEKYLSEYCFSGAYILSLLQGYNFTDSSWEQIHFMGKIKDSNAGWTLGYMLNLTNMIPAEQPLSPPLPHSTYIGLMVLFSLLLVAVAITGLFIYSKPSYFWKEAV

SEQ ID NO: 352 - DNA, 1530 bp, Mus musculus
atggaagatataaaggattctaaggtgaagagattttgctccaaaaatattctgatcatccttggtttcacctctatcttggctgtgatagctttgattgctgtgggactgacccagaacaaacctttgccagaaaatgttaagtatgggattgtgttggatgcggggtcatctcacaccaacctgtacatctacaagtggccggccgagaaggagaatgacacaggggtggtgcagcagttagaggaatgccaagtgaaaggtcctggaatctcaaaatatgctcagaaaacagatgaaatcggtgcgtacctggccgaatgcatggaactgtccaccgaactgataccaacatccaagcatcaccagactcctgtctacctgggagccacagcaggcatgcgcttgcttagaatggaaagcgaacaatcggcagacgaggtcctggctgcagtgtcaacaagccttaagagctacccctttgacttccagggtgccaagatcatcactggacaagaggaaggtgcctatgggtggattactattaactatctgctgggcagattcactcaggaacagagttggctaagcctcatctcagacagtcagaaacaggaaacctttggcgctttggatctcggcggagcctccacacagatcaccttcgtgccccaaaacagcactatagagtccccagaaaactctctgcaattccgtctctatggcgaggactatactgtgtacacacacagcttcctgtgctatgggaaggatcaggctctctggcagaaactggccaaggacattcaggtttcaagtggtggcgtccttaaggacccatgctttaacccaggatacgagaaggttgtgaatgtaagtgagctctatggcactccctgcaccaaaagattcgaaaagaagctaccatttgatcagtttcgaatccagggcactggagactacgaacagtgccaccagagcatccttgagctcttcaacaacagccactgcccttactcccagtgtgccttcaatggcgtcttcctgccacctctccatgggagttttggggcgttttctgctttctactttgtgatggatttttttaagaaggtagcgaaaaacagtgtcatctctcaggagaaaatgaccgagataacaaaaaatttttgctcaaaatcttgggaagagacaaagacatcttatccttcagtaaaggagaagtacctgagtgagtactgcttctcgggcgcctacatcctctctctcctgcaaggctataacttcacagacagctcctgggaacagattcattttatgggcaagatcaaagacagcaacgcggggtggactttgggctacatgctgaacttgaccaacatgatcccagctgaacagccgttgtccccgcctctccctcactccacctacatcggcctcatggttctcttctccctgctcttggttgctgtggccatcacaggcctgttcatctatagcaagccttcatatttctggaaagaggcagta

SEQ ID NO: 353-500 - skipped (148 entries)

SEQ ID NO: 501 - protein, 5 aa, Artificial Sequence
  source: /note="Description of Artificial Sequence: Synthetic peptide"
TYWMH

SEQ ID NO: 502 - protein, 17 aa, Artificial Sequence
  source: /note="Description of Artificial Sequence: Synthetic peptide"
NIYPGTGGSNFDEKFKN

SEQ ID NO: 503 - protein, 8 aa, Artificial Sequence
  source: /note="Description of Artificial Sequence: Synthetic peptide"
WTTGTGAY

SEQ ID NO: 504 - protein, 7 aa, Artificial Sequence
  source: /note="Description of Artificial Sequence: Synthetic peptide"
GYTFTTY

SEQ ID NO: 505 - protein, 6 aa, Artificial Sequence
  source: /note="Description of Artificial Sequence: Synthetic peptide"
YPGTGG

SEQ ID NO: 506 - protein, 117 aa, Artificial Sequence
  source: /note="Description of Artificial Sequence: Synthetic polypeptide"
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 507 - DNA, 351 bp, Artificial Sequence
  source: /note="Description of Artificial Sequence: Synthetic polynucleotide"
gaggtgcagctggtgcagtcaggcgccgaagtgaagaagcccggcgagtcactgagaattagctgtaaaggttcaggctacaccttcactacctactggatgcactgggtccgccaggctaccggtcaaggcctcgagtggatgggtaatatctaccccggcaccggcggctctaacttcgacgagaagtttaagaatagagtgactatcaccgccgataagtctactagcaccgcctatatggaactgtctagcctgagatcagaggacaccgccgtctactactgcactaggtggactaccggcacaggcgcctactggggtcaaggcactaccgtgaccgtgtctagc

SEQ ID NO: 508 - protein, 443 aa, Artificial Sequence
  source: /note="Description of Artificial Sequence: Synthetic polypeptide"
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 509 - DNA, 1329 bp, Artificial Sequence
  source: /note="Description of Artificial Sequence: Synthetic polynucleotide"
gaggtgcagctggtgcagtcaggcgccgaagtgaagaagcccggcgagtcactgagaattagctgtaaaggttcaggctacaccttcactacctactggatgcactgggtccgccaggctaccggtcaaggcctcgagtggatgggtaatatctaccccggcaccggcggctctaacttcgacgagaagtttaagaatagagtgactatcaccgccgataagtctactagcaccgcctatatggaactgtctagcctgagatcagaggacaccgccgtctactactgcactaggtggactaccggcacaggcgcctactggggtcaaggcactaccgtgaccgtgtctagcgctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 510 - protein, 17 aa, Artificial Sequence
  source: /note="Description of Artificial Sequence: Synthetic peptide"
KSSQSLLDSGNQKNFLT

SEQ ID NO: 511 - protein, 7 aa, Artificial Sequence
  source: /note="Description of Artificial Sequence: Synthetic peptide"
WASTRES

SEQ ID NO: 512 - protein, 9 aa, Artificial Sequence
  source: /note="Description of Artificial Sequence: Synthetic peptide"
QNDYSYPYT

SEQ ID NO: 513 - protein, 13 aa, Artificial Sequence
  source: /note="Description of Artificial Sequence: Synthetic peptide"
SQSLLDSGNQKNF

SEQ ID NO: 514 - protein, 3 aa, Artificial Sequence
  source: /note="Description of Artificial Sequence: Synthetic peptide"
WAS

SEQ ID NO: 515 - protein, 6 aa, Artificial Sequence
  source: /note="Description of Artificial Sequence: Synthetic peptide"
DYSYPY

SEQ ID NO: 516 - protein, 113 aa, Artificial Sequence
  source: /note="Description of Artificial Sequence: Synthetic polypeptide"
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 517 - DNA, 339 bp, Artificial Sequence
  source: /note="Description of Artificial Sequence: Synthetic polynucleotide"
gagatcgtcctgactcagtcacccgctaccctgagcctgagccctggcgagcgggctacactgagctgtaaatctagtcagtcactgctggatagcggtaatcagaagaacttcctgacctggtatcagcagaagcccggtaaagcccctaagctgctgatctactgggcctctactagagaatcaggcgtgccctctaggtttagcggtagcggtagtggcaccgacttcaccttcactatctctagcctgcagcccgaggatatcgctacctactactgtcagaacgactatagctacccctacaccttcggtcaaggcactaaggtcgagattaag

SEQ ID NO: 518 - protein, 220 aa, Artificial Sequence
  source: /note="Description of Artificial Sequence: Synthetic polypeptide"
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 519 - DNA, 660 bp, Artificial Sequence
  source: /note="Description of Artificial Sequence: Synthetic polynucleotide"
gagatcgtcctgactcagtcacccgctaccctgagcctgagccctggcgagcgggctacactgagctgtaaatctagtcagtcactgctggatagcggtaatcagaagaacttcctgacctggtatcagcagaagcccggtaaagcccctaagctgctgatctactgggcctctactagagaatcaggcgtgccctctaggtttagcggtagcggtagtggcaccgacttcaccttcactatctctagcctgcagcccgaggatatcgctacctactactgtcagaacgactatagctacccctacaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 520 - protein, 113 aa, Artificial Sequence
  source: /note="Description of Artificial Sequence: Synthetic polypeptide"
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 521 - DNA, 339 bp, Artificial Sequence
  source: /note="Description of Artificial Sequence: Synthetic polynucleotide"
gagatcgtcctgactcagtcacccgctaccctgagcctgagccctggcgagcgggctacactgagctgtaaatctagtcagtcactgctggatagcggtaatcagaagaacttcctgacctggtatcagcagaagcccggtcaagcccctagactgctgatctactgggcctctactagagaatcaggcgtgccctctaggtttagcggtagcggtagtggcaccgacttcaccttcactatctctagcctggaagccgaggacgccgctacctactactgtcagaacgactatagctacccctacaccttcggtcaaggcactaaggtcgagattaag

SEQ ID NO: 522 - protein, 220 aa, Artificial Sequence
  source: /note="Description of Artificial Sequence: Synthetic polypeptide"
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - DNA, 660 bp, Artificial Sequence
  source: /note="Description of Artificial Sequence: Synthetic polynucleotide"
gagatcgtcctgactcagtcacccgctaccctgagcctgagccctggcgagcgggctacactgagctgtaaatctagtcagtcactgctggatagcggtaatcagaagaacttcctgacctggtatcagcagaagcccggtcaagcccctagactgctgatctactgggcctctactagagaatcaggcgtgccctctaggtttagcggtagcggtagtggcaccgacttcaccttcactatctctagcctggaagccgaggacgccgctacctactactgtcagaacgactatagctacccctacaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 524 - DNA, 15 bp, Artificial Sequence
  source: /note="Description of Artificial Sequence: Synthetic oligonucleotide"
acctactggatgcac

SEQ ID NO: 525 - DNA, 51 bp, Artificial Sequence
  source: /note="Description of Artificial Sequence: Synthetic oligonucleotide"
aatatctaccccggcaccggcggctctaacttcgacgagaagtttaagaat

SEQ ID NO: 526 - DNA, 24 bp, Artificial Sequence
  source: /note="Description of Artificial Sequence: Synthetic oligonucleotide"
tggactaccggcacaggcgcctac

SEQ ID NO: 527 - DNA, 21 bp, Artificial Sequence
  source: /note="Description of Artificial Sequence: Synthetic oligonucleotide"
ggctacaccttcactacctac

SEQ ID NO: 528 - DNA, 18 bp, Artificial Sequence
  source: /note="Description of Artificial Sequence: Synthetic oligonucleotide"
taccccggcaccggcggc

SEQ ID NO: 529 - DNA, 51 bp, Artificial Sequence
  source: /note="Description of Artificial Sequence: Synthetic oligonucleotide"
aaatctagtcagtcactgctggatagcggtaatcagaagaacttcctgacc

SEQ ID NO: 530 - DNA, 21 bp, Artificial Sequence
  source: /note="Description of Artificial Sequence: Synthetic oligonucleotide"
tgggcctctactagagaatca

SEQ ID NO: 531 - DNA, 27 bp, Artificial Sequence
  source: /note="Description of Artificial Sequence: Synthetic oligonucleotide"
cagaacgactatagctacccctacacc

SEQ ID NO: 532 - DNA, 39 bp, Artificial Sequence
  source: /note="Description of Artificial Sequence: Synthetic oligonucleotide"
agtcagtcactgctggatagcggtaatcagaagaacttc

SEQ ID NO: 533 - DNA, 9 bp, Artificial Sequence
  source: /note="Description of Artificial Sequence: Synthetic oligonucleotide"
tgggcctct

SEQ ID NO: 534 - DNA, 18 bp, Artificial Sequence
  source: /note="Description of Artificial Sequence: Synthetic oligonucleotide"
gactatagctacccctac

SEQ ID NO: 535 - protein, 440 aa, Artificial Sequence
  source: /note="Description of Artificial Sequence: Synthetic polypeptide"
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 536 - protein, 214 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 537 - protein, 447 aa, Artificial Sequence
  source: /note="Description of Artificial Sequence: Synthetic polypeptide"
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 538 - protein, 218 aa, Artificial Sequence
  source: /note="Description of Artificial Sequence: Synthetic polypeptide"
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 539 - protein, 447 aa, Artificial Sequence
  source: /note="Description of Artificial Sequence: Synthetic polypeptide"
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 540 - protein, 213 aa, Artificial Sequence
  source: /note="Description of Artificial Sequence: Synthetic polypeptide"
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 541 - protein, 10 aa, Artificial Sequence
  source: /note="Description of Artificial Sequence: Synthetic peptide"
GYTFTTYWMH

SEQ ID NO: 542-600 - skipped (59 entries)

SEQ ID NO: 601 - protein, 5 aa, Artificial Sequence
  source: /note="Description of Artificial Sequence: Synthetic peptide"
SYWMY

SEQ ID NO: 602 - protein, 17 aa, Artificial Sequence
  source: /note="Description of Artificial Sequence: Synthetic peptide"
RIDPNSGSTKYNEKFKN

SEQ ID NO: 603 - protein, 11 aa, Artificial Sequence
  source: /note="Description of Artificial Sequence: Synthetic peptide"
DYRKGLYAMDY

SEQ ID NO: 604 - protein, 7 aa, Artificial Sequence
  source: /note="Description of Artificial Sequence: Synthetic peptide"
GYTFTSY

SEQ ID NO: 605 - protein, 6 aa, Artificial Sequence
  source: /note="Description of Artificial Sequence: Synthetic peptide"
DPNSGS

SEQ ID NO: 606 - protein, 120 aa, Artificial Sequence
  source: /note="Description of Artificial Sequence: Synthetic polypeptide"
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 607 - DNA, 360 bp, Artificial Sequence
  source: /note="Description of Artificial Sequence: Synthetic polynucleotide"
gaagtgcagctggtgcagtcaggcgccgaagtgaagaaacccggcgctaccgtgaagattagctgtaaagtctcaggctacaccttcactagctactggatgtactgggtccgacaggctagagggcaaagactggagtggatcggtagaatcgaccctaatagcggctctactaagtataacgagaagtttaagaataggttcactattagtagggataactctaagaacaccctgtacctgcagatgaatagcctgagagccgaggacaccgccgtctactactgcgctagagactatagaaagggcctgtacgctatggactactggggtcaaggcactaccgtgaccgtgtcttca

SEQ ID NO: 608 - protein, 446 aa, Artificial Sequence
  source: /note="Description of Artificial Sequence: Synthetic polypeptide"
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 609 - protein, 11 aa, Artificial Sequence
  source: /note="Description of Artificial Sequence: Synthetic peptide"
KASQDVGTAVA

SEQ ID NO: 610 - protein, 7 aa, Artificial Sequence
  source: /note="Description of Artificial Sequence: Synthetic peptide"
WASTRHT

SEQ ID NO: 611 - protein, 9 aa, Artificial Sequence
  source: /note="Description of Artificial Sequence: Synthetic peptide"
QQYNSYPLT

SEQ ID NO: 612 - protein, 7 aa, Artificial Sequence
  source: /note="Description of Artificial Sequence: Synthetic peptide"
SQDVGTA

SEQ ID NO: 613 - protein, 3 aa, Artificial Sequence
  source: /note="Description of Artificial Sequence: Synthetic peptide"
WAS

SEQ ID NO: 614 - protein, 6 aa, Artificial Sequence
  source: /note="Description of Artificial Sequence: Synthetic peptide"
YNSYPL

SEQ ID NO: 615 - DNA, 1338 bp, Artificial Sequence
  source: /note="Description of Artificial Sequence: Synthetic polynucleotide"
gaagtgcagctggtgcagtcaggcgccgaagtgaagaaacccggcgctaccgtgaagattagctgtaaagtctcaggctacaccttcactagctactggatgtactgggtccgacaggctagagggcaaagactggagtggatcggtagaatcgaccctaatagcggctctactaagtataacgagaagtttaagaataggttcactattagtagggataactctaagaacaccctgtacctgcagatgaatagcctgagagccgaggacaccgccgtctactactgcgctagagactatagaaagggcctgtacgctatggactactggggtcaaggcactaccgtgaccgtgtcttcagctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 616 - protein, 107 aa, Artificial Sequence
  source: /note="Description of Artificial Sequence: Synthetic polypeptide"
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 617 - DNA, 321 bp, Artificial Sequence
  source: /note="Description of Artificial Sequence: Synthetic polynucleotide"
gctattcagctgactcagtcacctagtagcctgagcgctagtgtgggcgatagagtgactatcacctgtaaagcctctcaggacgtgggcaccgccgtggcctggtatctgcagaagcctggtcaatcacctcagctgctgatctactgggcctctactagacacaccggcgtgccctctaggtttagcggtagcggtagtggcaccgacttcaccttcactatctcttcactggaagccgaggacgccgctacctactactgtcagcagtataatagctaccccctgaccttcggtcaaggcactaaggtcgagattaag

SEQ ID NO: 618 - protein, 214 aa, Artificial Sequence
  source: /note="Description of Artificial Sequence: Synthetic polypeptide"
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 619 - DNA, 642 bp, Artificial Sequence
  source: /note="Description of Artificial Sequence: Synthetic polynucleotide"
gctattcagctgactcagtcacctagtagcctgagcgctagtgtgggcgatagagtgactatcacctgtaaagcctctcaggacgtgggcaccgccgtggcctggtatctgcagaagcctggtcaatcacctcagctgctgatctactgggcctctactagacacaccggcgtgccctctaggtttagcggtagcggtagtggcaccgacttcaccttcactatctcttcactggaagccgaggacgccgctacctactactgtcagcagtataatagctaccccctgaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 620 - protein, 120 aa, Artificial Sequence
  source: /note="Description of Artificial Sequence: Synthetic polypeptide"
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 621 - DNA, 360 bp, Artificial Sequence
  source: /note="Description of Artificial Sequence: Synthetic polynucleotide"
gaagtgcagctggtgcagtcaggcgccgaagtgaagaaacccggcgctaccgtgaagattagctgtaaagtctcaggctacaccttcactagctactggatgtactgggtccgacaggctaccggtcaaggcctggagtggatgggtagaatcgaccctaatagcggctctactaagtataacgagaagtttaagaatagagtgactatcaccgccgataagtctactagcaccgcctatatggaactgtctagcctgagatcagaggacaccgccgtctactactgcgctagagactatagaaagggcctgtacgctatggactactggggtcaaggcactaccgtgaccgtgtcttca

SEQ ID NO: 622 - protein, 446 aa, Artificial Sequence
  source: /note="Description of Artificial Sequence: Synthetic polypeptide"
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 623 - DNA, 1338 bp, Artificial Sequence
  source: /note="Description of Artificial Sequence: Synthetic polynucleotide"
gaagtgcagctggtgcagtcaggcgccgaagtgaagaaacccggcgctaccgtgaagattagctgtaaagtctcaggctacaccttcactagctactggatgtactgggtccgacaggctaccggtcaaggcctggagtggatgggtagaatcgaccctaatagcggctctactaagtataacgagaagtttaagaatagagtgactatcaccgccgataagtctactagcaccgcctatatggaactgtctagcctgagatcagaggacaccgccgtctactactgcgctagagactatagaaagggcctgtacgctatggactactggggtcaaggcactaccgtgaccgtgtcttcagctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 624 - protein, 107 aa, Artificial Sequence
  source: /note="Description of Artificial Sequence: Synthetic polypeptide"
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 625 - DNA, 321 bp, Artificial Sequence
  source: /note="Description of Artificial Sequence: Synthetic polynucleotide"
gacgtcgtgatgactcagtcacccctgagcctgcccgtgaccctggggcagcccgcctctattagctgtaaagcctctcaggacgtgggcaccgccgtggcctggtatcagcagaagccagggcaagcccctagactgctgatctactgggcctctactagacacaccggcgtgccctctaggtttagcggtagcggtagtggcaccgagttcaccctgactatctcttcactgcagcccgacgacttcgctacctactactgtcagcagtataatagctaccccctgaccttcggtcaaggcactaaggtcgagattaag

SEQ ID NO: 626 - protein, 214 aa, Artificial Sequence
  source: /note="Description of Artificial Sequence: Synthetic polypeptide"
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 627 - DNA, 642 bp, Artificial Sequence
  source: /note="Description of Artificial Sequence: Synthetic polynucleotide"
gacgtcgtgatgactcagtcacccctgagcctgcccgtgaccctggggcagcccgcctctattagctgtaaagcctctcaggacgtgggcaccgccgtggcctggtatcagcagaagccagggcaagcccctagactgctgatctactgggcctctactagacacaccggcgtgccctctaggtttagcggtagcggtagtggcaccgagttcaccctgactatctcttcactgcagcccgacgacttcgctacctactactgtcagcagtataatagctaccccctgaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 628 - DNA, 15 bp, Artificial Sequence
  source: /note="Description of Artificial Sequence: Synthetic oligonucleotide"
agctactggatgtac

SEQ ID NO: 629 - DNA, 51 bp, Artificial Sequence
  source: /note="Description of Artificial Sequence: Synthetic oligonucleotide"
agaatcgaccctaatagcggctctactaagtataacgagaagtttaagaat

SEQ ID NO: 630 - DNA, 33 bp, Artificial Sequence
  source: /note="Description of Artificial Sequence: Synthetic oligonucleotide"
gactatagaaagggcctgtacgctatggactac

SEQ ID NO: 631 - DNA, 21 bp, Artificial Sequence
  source: /note="Description of Artificial Sequence: Synthetic oligonucleotide"
ggctacaccttcactagctac

SEQ ID NO: 632 - DNA, 18 bp, Artificial Sequence
  source: /note="Description of Artificial Sequence: Synthetic oligonucleotide"
gaccctaatagcggctct

SEQ ID NO: 633 - DNA, 33 bp, Artificial Sequence
  source: /note="Description of Artificial Sequence: Synthetic oligonucleotide"
aaagcctctcaggacgtgggcaccgccgtggcc

SEQ ID NO: 634 - DNA, 21 bp, Artificial Sequence
  source: /note="Description of Artificial Sequence: Synthetic oligonucleotide"
tgggcctctactagacacacc

SEQ ID NO: 635 - DNA, 27 bp, Artificial Sequence
  source: /note="Description of Artificial Sequence: Synthetic oligonucleotide"
cagcagtataatagctaccccctgacc

SEQ ID NO: 636 - DNA, 21 bp, Artificial Sequence
  source: /note="Description of Artificial Sequence: Synthetic oligonucleotide"
tctcaggacgtgggcaccgcc

SEQ ID NO: 637 - DNA, 9 bp, Artificial Sequence
  source: /note="Description of Artificial Sequence: Synthetic oligonucleotide"
tgggcctct

SEQ ID NO: 638 - DNA, 18 bp, Artificial Sequence
  source: /note="Description of Artificial Sequence: Synthetic oligonucleotide"
tataatagctaccccctg

SEQ ID NO: 639 - protein, 448 aa, Artificial Sequence
  source: /note="Description of Artificial Sequence: Synthetic polypeptide"
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 640 - protein, 214 aa, Artificial Sequence
  source: /note="Description of Artificial Sequence: Synthetic polypeptide"
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 641 - protein, 450 aa, Artificial Sequence
  source: /note="Description of Artificial Sequence: Synthetic polypeptide"
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 642 - protein, 216 aa, Artificial Sequence
  source: /note="Description of Artificial Sequence: Synthetic polypeptide"
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 643 - protein, 451 aa, Artificial Sequence
  source: /note="Description of Artificial Sequence: Synthetic polypeptide"
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 644 - protein, 215 aa, Artificial Sequence
  source: /note="Description of Artificial Sequence: Synthetic polypeptide"
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 645 - protein, 123 aa, Artificial Sequence
  source: /note="Description of Artificial Sequence: Synthetic polypeptide"
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 646 - protein, 106 aa, Artificial Sequence
  source: /note="Description of Artificial Sequence: Synthetic polypeptide"
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 647 - protein, 10 aa, Artificial Sequence
  source: /note="Description of Artificial Sequence: Synthetic peptide"
GYTFTSYWMY

SEQ ID NO: 648-700 - skipped (53 entries)

SEQ ID NO: 701 - protein, 5 aa, Artificial Sequence
  source: /note="Description of Artificial Sequence: Synthetic peptide"
NYGMN

SEQ ID NO: 702 - protein, 17 aa, Artificial Sequence
  source: /note="Description of Artificial Sequence: Synthetic peptide"
WINTDTGEPTYADDFKG

SEQ ID NO: 703 - protein, 16 aa, Artificial Sequence
  source: /note="Description of Artificial Sequence: Synthetic peptide"
NPPYYYGTNNAEAMDY

SEQ ID NO: 704 - protein, 7 aa, Artificial Sequence
  source: /note="Description of Artificial Sequence: Synthetic peptide"
GFTLTNY

SEQ ID NO: 705 - protein, 6 aa, Artificial Sequence
  source: /note="Description of Artificial Sequence: Synthetic peptide"
NTDTGE

SEQ ID NO: 706 - protein, 125 aa, Artificial Sequence
  source: /note="Description of Artificial Sequence: Synthetic polypeptide"
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSS

SEQ ID NO: 707 - DNA, 375 bp, Artificial Sequence
  source: /note="Description of Artificial Sequence: Synthetic polynucleotide"
caagtgcagctggtgcagtcgggagccgaagtgaagaagcctggagcctcggtgaaggtgtcgtgcaaggcatccggattcaccctcaccaattacgggatgaactgggtcagacaggcccggggtcaacggctggagtggatcggatggattaacaccgacaccggggagcctacctacgcggacgatttcaagggacggttcgtgttctccctcgacacctccgtgtccaccgcctacctccaaatctcctcactgaaagcggaggacaccgccgtgtactattgcgcgaggaacccgccctactactacggaaccaacaacgccgaagccatggactactggggccagggcaccactgtgactgtgtccagc

SEQ ID NO: 708 - DNA, 375 bp, Artificial Sequence
  source: /note="Description of Artificial Sequence: Synthetic polynucleotide"
caggtgcagctggtgcagtctggcgccgaagtgaagaaacctggcgcctccgtgaaggtgtcctgcaaggcctctggcttcaccctgaccaactacggcatgaactgggtgcgacaggccaggggccagcggctggaatggatcggctggatcaacaccgacaccggcgagcctacctacgccgacgacttcaagggcagattcgtgttctccctggacacctccgtgtccaccgcctacctgcagatctccagcctgaaggccgaggataccgccgtgtactactgcgcccggaaccccccttactactacggcaccaacaacgccgaggccatggactattggggccagggcaccaccgtgaccgtgtcctct

SEQ ID NO: 709 - protein, 451 aa, Artificial Sequence
  source: /note="Description of Artificial Sequence: Synthetic polypeptide"
QVQLVQSGAEVKKPGASVKVSCKASGFTLTNYGMNWVRQARGQRLEWIGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 710 - protein, 11 aa, Artificial Sequence
  source: /note="Description of Artificial Sequence: Synthetic peptide"
SSSQDISNYLN

SEQ ID NO: 711 - protein, 7 aa, Artificial Sequence
  source: /note="Description of Artificial Sequence: Synthetic peptide"
YTSTLHL

SEQ ID NO: 712 - protein, 9 aa, Artificial Sequence
  source: /note="Description of Artificial Sequence: Synthetic peptide"
QQYYNLPWT

SEQ ID NO: 713 - protein, 7 aa, Artificial Sequence
  source: /note="Description of Artificial Sequence: Synthetic peptide"
SQDISNY

SEQ ID NO: 714 - protein, 3 aa, Artificial Sequence
  source: /note="Description of Artificial Sequence: Synthetic peptide"
YTS

SEQ ID NO: 715 - protein, 6 aa, Artificial Sequence
  source: /note="Description of Artificial Sequence: Synthetic peptide"
YYNLPW

SEQ ID NO: 716 - DNA, 1353 bp, Artificial Sequence
  source: /note="Description of Artificial Sequence: Synthetic polynucleotide"
caagtgcagctggtgcagtcgggagccgaagtgaagaagcctggagcctcggtgaaggtgtcgtgcaaggcatccggattcaccctcaccaattacgggatgaactgggtcagacaggcccggggtcaacggctggagtggatcggatggattaacaccgacaccggggagcctacctacgcggacgatttcaagggacggttcgtgttctccctcgacacctccgtgtccaccgcctacctccaaatctcctcactgaaagcggaggacaccgccgtgtactattgcgcgaggaacccgccctactactacggaaccaacaacgccgaagccatggactactggggccagggcaccactgtgactgtgtccagcgcgtccactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 717 - DNA, 1353 bp, Artificial Sequence
  source: /note="Description of Artificial Sequence: Synthetic polynucleotide"
caggtgcagctggtgcagtctggcgccgaagtgaagaaacctggcgcctccgtgaaggtgtcctgcaaggcctctggcttcaccctgaccaactacggcatgaactgggtgcgacaggccaggggccagcggctggaatggatcggctggatcaacaccgacaccggcgagcctacctacgccgacgacttcaagggcagattcgtgttctccctggacacctccgtgtccaccgcctacctgcagatctccagcctgaaggccgaggataccgccgtgtactactgcgcccggaaccccccttactactacggcaccaacaacgccgaggccatggactattggggccagggcaccaccgtgaccgtgtcctctgcttctaccaaggggcccagcgtgttccccctggccccctgctccagaagcaccagcgagagcacagccgccctgggctgcctggtgaaggactacttccccgagcccgtgaccgtgtcctggaacagcggagccctgaccagcggcgtgcacaccttccccgccgtgctgcagagcagcggcctgtacagcctgagcagcgtggtgaccgtgcccagcagcagcctgggcaccaagacctacacctgtaacgtggaccacaagcccagcaacaccaaggtggacaagagggtggagagcaagtacggcccaccctgccccccctgcccagcccccgagttcctgggcggacccagcgtgttcctgttcccccccaagcccaaggacaccctgatgatcagcagaacccccgaggtgacctgtgtggtggtggacgtgtcccaggaggaccccgaggtccagttcaactggtacgtggacggcgtggaggtgcacaacgccaagaccaagcccagagaggagcagtttaacagcacctaccgggtggtgtccgtgctgaccgtgctgcaccaggactggctgaacggcaaagagtacaagtgtaaggtctccaacaagggcctgccaagcagcatcgaaaagaccatcagcaaggccaagggccagcctagagagccccaggtctacaccctgccacccagccaagaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaggctgaccgtggacaagtccagatggcaggagggcaacgtctttagctgctccgtgatgcacgaggccctgcacaaccactacacccagaagagcctgagcctgtccctgggc

SEQ ID NO: 718 - protein, 107 aa, Artificial Sequence
  source: /note="Description of Artificial Sequence: Synthetic polypeptide"
DIQMTQSPSSLSASVGDRVTITCSSSQDISNYLNWYLQKPGQSPQLLIYYTSTLHLGVPSRFSGSGSGTEFTLTISSLQPDDFATYYCQQYYNLPWTFGQGTKVEIK

SEQ ID NO: 719 - DNA, 321 bp, Artificial Sequence
  source: /note="Description of Artificial Sequence: Synthetic polynucleotide"
gatattcagatgactcagtcacctagtagcctgagcgctagtgtgggcgatagagtgactatcacctgtagctctagtcaggatatctctaactacctgaactggtatctgcagaagcccggtcaatcacctcagctgctgatctactacactagcaccctgcacctgggcgtgccctctaggtttagcggtagcggtagtggcaccgagttcaccctgactatctctagcctgcagcccgacgacttcgctacctactactgtcagcagtactataacctgccctggaccttcggtcaaggcactaaggtcgagattaag

SEQ ID NO: 720 - DNA, 321 bp, Artificial Sequence
  source: /note="Description of Artificial Sequence: Synthetic polynucleotide"
gacatccagatgacccagtccccctccagcctgtctgcttccgtgggcgacagagtgaccatcacctgttcctccagccaggacatctccaactacctgaactggtatctgcagaagcccggccagtcccctcagctgctgatctactacacctccaccctgcacctgggcgtgccctccagattttccggctctggctctggcaccgagtttaccctgaccatcagctccctgcagcccgacgacttcgccacctactactgccagcagtactacaacctgccctggaccttcggccagggcaccaaggtggaaatcaag

SEQ ID NO: 721 - protein, 214 aa, Artificial Sequence
  source: /note="Description of Artificial Sequence: Synthetic polypeptide"
DIQMTQSPSSLSASVGDRVTITCSSSQDISNYLNWYLQKPGQSPQLLIYYTSTLHLGVPSRFSGSGSGTEFTLTISSLQPDDFATYYCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 722 - DNA, 642 bp, Artificial Sequence
  source: /note="Description of Artificial Sequence: Synthetic polynucleotide"
gatattcagatgactcagtcacctagtagcctgagcgctagtgtgggcgatagagtgactatcacctgtagctctagtcaggatatctctaactacctgaactggtatctgcagaagcccggtcaatcacctcagctgctgatctactacactagcaccctgcacctgggcgtgccctctaggtttagcggtagcggtagtggcaccgagttcaccctgactatctctagcctgcagcccgacgacttcgctacctactactgtcagcagtactataacctgccctggaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 723 - DNA, 642 bp, Artificial Sequence
  source: /note="Description of Artificial Sequence: Synthetic polynucleotide"
gacatccagatgacccagtccccctccagcctgtctgcttccgtgggcgacagagtgaccatcacctgttcctccagccaggacatctccaactacctgaactggtatctgcagaagcccggccagtcccctcagctgctgatctactacacctccaccctgcacctgggcgtgccctccagattttccggctctggctctggcaccgagtttaccctgaccatcagctccctgcagcccgacgacttcgccacctactactgccagcagtactacaacctgccctggaccttcggccagggcaccaaggtggaaatcaagcgtacggtggccgctcccagcgtgttcatcttccccccaagcgacgagcagctgaagagcggcaccgccagcgtggtgtgtctgctgaacaacttctaccccagggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcacaaggtgtacgcctgtgaggtgacccaccagggcctgtccagccccgtgaccaagagcttcaacaggggcgagtgc

SEQ ID NO: 724 - protein, 125 aa, Artificial Sequence
  source: /note="Description of Artificial Sequence: Synthetic polypeptide"
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSS

SEQ ID NO: 725 - DNA, 375 bp, Artificial Sequence
  source: /note="Description of Artificial Sequence: Synthetic polynucleotide"
caggtgcagctggtgcagtcaggcgccgaagtgaagaaacccggcgctagtgtgaaagtcagctgtaaagctagtggcttcaccctgactaactacgggatgaactgggtccgccaggccccaggtcaaggcctcgagtggatgggctggattaacaccgacaccggcgagcctacctacgccgacgactttaagggcagattcgtgtttagcctggacactagtgtgtctaccgcctacctgcagatctctagcctgaaggccgaggacaccgccgtctactactgcgctagaaaccccccctactactacggcactaacaacgccgaggctatggactactggggtcaaggcactaccgtgaccgtgtctagc

SEQ ID NO: 726 - DNA, 375 bp, Artificial Sequence
  source: /note="Description of Artificial Sequence: Synthetic polynucleotide"
caggtgcagctggtgcagtctggcgccgaagtgaagaaacctggcgcctccgtgaaggtgtcctgcaaggcctctggcttcaccctgaccaactacggcatgaactgggtgcgacaggcccctggacagggcctggaatggatgggctggatcaacaccgacaccggcgagcctacctacgccgacgacttcaagggcagattcgtgttctccctggacacctccgtgtccaccgcctacctgcagatctccagcctgaaggccgaggataccgccgtgtactactgcgcccggaaccccccttactactacggcaccaacaacgccgaggccatggactattggggccagggcaccaccgtgaccgtgtcctct

SEQ ID NO: 727 - protein, 451 aa, Artificial Sequence
  source: /note="Description of Artificial Sequence: Synthetic polypeptide"
QVQLVQSGAEVKKPGASVKVSCKASGFTLTNYGMNWVRQAPGQGLEWMGWINTDTGEPTYADDFKGRFVFSLDTSVSTAYLQISSLKAEDTAVYYCARNPPYYYGTNNAEAMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 728 - DNA, 1353 bp, Artificial Sequence
  source: /note="Description of Artificial Sequence: Synthetic polynucleotide"
caggtgcagctggtgcagtcaggcgccgaagtgaagaaacccggcgctagtgtgaaagtcagctgtaaagctagtggcttcaccctgactaactacgggatgaactgggtccgccaggccccaggtcaaggcctcgagtggatgggctggattaacaccgacaccggcgagcctacctacgccgacgactttaagggcagattcgtgtttagcctggacactagtgtgtctaccgcctacctgcagatctctagcctgaaggccgaggacaccgccgtctactactgcgctagaaaccccccctactactacggcactaacaacgccgaggctatggactactggggtcaaggcactaccgtgaccgtgtctagcgctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 729 - DNA, 1353 bp, Artificial Sequence
  source: /note="Description of Artificial Sequence: Synthetic polynucleotide"
caggtgcagctggtgcagtctggcgccgaagtgaagaaacctggcgcctccgtgaaggtgtcctgcaaggcctctggcttcaccctgaccaactacggcatgaactgggtgcgacaggcccctggacagggcctggaatggatgggctggatcaacaccgacaccggcgagcctacctacgccgacgacttcaagggcagattcgtgttctccctggacacctccgtgtccaccgcctacctgcagatctccagcctgaaggccgaggataccgccgtgtactactgcgcccggaaccccccttactactacggcaccaacaacgccgaggccatggactattggggccagggcaccaccgtgaccgtgtcctctgcttctaccaaggggcccagcgtgttccccctggccccctgctccagaagcaccagcgagagcacagccgccctgggctgcctggtgaaggactacttccccgagcccgtgaccgtgtcctggaacagcggagccctgaccagcggcgtgcacaccttccccgccgtgctgcagagcagcggcctgtacagcctgagcagcgtggtgaccgtgcccagcagcagcctgggcaccaagacctacacctgtaacgtggaccacaagcccagcaacaccaaggtggacaagagggtggagagcaagtacggcccaccctgccccccctgcccagcccccgagttcctgggcggacccagcgtgttcctgttcccccccaagcccaaggacaccctgatgatcagcagaacccccgaggtgacctgtgtggtggtggacgtgtcccaggaggaccccgaggtccagttcaactggtacgtggacggcgtggaggtgcacaacgccaagaccaagcccagagaggagcagtttaacagcacctaccgggtggtgtccgtgctgaccgtgctgcaccaggactggctgaacggcaaagagtacaagtgtaaggtctccaacaagggcctgccaagcagcatcgaaaagaccatcagcaaggccaagggccagcctagagagccccaggtctacaccctgccacccagccaagaggagatgaccaagaaccaggtgtccctgacctgtctggtgaagggcttctacccaagcgacatcgccgtggagtgggagagcaacggccagcccgagaacaactacaagaccacccccccagtgctggacagcgacggcagcttcttcctgtacagcaggctgaccgtggacaagtccagatggcaggagggcaacgtctttagctgctccgtgatgcacgaggccctgcacaaccactacacccagaagagcctgagcctgtccctgggc

SEQ ID NO: 730 - protein, 107 aa, Artificial Sequence
  source: /note="Description of Artificial Sequence: Synthetic polypeptide"
DIQMTQSPSSLSASVGDRVTITCSSSQDISNYLNWYQQKPGKAPKLLIYYTSTLHLGIPPRFSGSGYGTDFTLTINNIESEDAAYYFCQQYYNLPWTFGQGTKVEIK

SEQ ID NO: 731 - DNA, 321 bp, Artificial Sequence
  source: /note="Description of Artificial Sequence: Synthetic polynucleotide"
gatattcagatgactcagtcacctagtagcctgagcgctagtgtgggcgatagagtgactatcacctgtagctctagtcaggatatctctaactacctgaactggtatcagcagaagcccggtaaagcccctaagctgctgatctactacactagcaccctgcacctgggaatcccccctaggtttagcggtagcggctacggcaccgacttcaccctgactattaacaatatcgagtcagaggacgccgcctactacttctgtcagcagtactataacctgccctggaccttcggtcaaggcactaaggtcgagattaag

SEQ ID NO: 732 - DNA, 321 bp, Artificial Sequence
  source: /note="Description of Artificial Sequence: Synthetic polynucleotide"
gacatccagatgacccagtccccctccagcctgtctgcttccgtgggcgacagagtgaccatcacctgttcctccagccaggacatctccaactacctgaactggtatcagcagaagcccggcaaggcccccaagctgctgatctactacacctccaccctgcacctgggcatcccccctagattctccggctctggctacggcaccgacttcaccctgaccatcaacaacatcgagtccgaggacgccgcctactacttctgccagcagtactacaacctgccctggaccttcggccagggcaccaaggtggaaatcaag

SEQ ID NO: 733 - protein, 214 aa, Artificial Sequence
  source: /note="Description of Artificial Sequence: Synthetic polypeptide"
DIQMTQSPSSLSASVGDRVTITCSSSQDISNYLNWYQQKPGKAPKLLIYYTSTLHLGIPPRFSGSGYGTDFTLTINNIESEDAAYYFCQQYYNLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 734 - DNA, 642 bp, Artificial Sequence
  source: /note="Description of Artificial Sequence: Synthetic polynucleotide"
gatattcagatgactcagtcacctagtagcctgagcgctagtgtgggcgatagagtgactatcacctgtagctctagtcaggatatctctaactacctgaactggtatcagcagaagcccggtaaagcccctaagctgctgatctactacactagcaccctgcacctgggaatcccccctaggtttagcggtagcggctacggcaccgacttcaccctgactattaacaatatcgagtcagaggacgccgcctactacttctgtcagcagtactataacctgccctggaccttcggtcaaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 735 - DNA, 642 bp, Artificial Sequence
  source: /note="Description of Artificial Sequence: Synthetic polynucleotide"
gacatccagatgacccagtccccctccagcctgtctgcttccgtgggcgacagagtgaccatcacctgttcctccagccaggacatctccaactacctgaactggtatcagcagaagcccggcaaggcccccaagctgctgatctactacacctccaccctgcacctgggcatcccccctagattctccggctctggctacggcaccgacttcaccctgaccatcaacaacatcgagtccgaggacgccgcctactacttctgccagcagtactacaacctgccctggaccttcggccagggcaccaaggtggaaatcaagcgtacggtggccgctcccagcgtgttcatcttccccccaagcgacgagcagctgaagagcggcaccgccagcgtggtgtgtctgctgaacaacttctaccccagggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcacaaggtgtacgcctgtgaggtgacccaccagggcctgtccagccccgtgaccaagagcttcaacaggggcgagtgc

SEQ ID NO: 736 - DNA, 15 bp, Artificial Sequence
  source: /note="Description of Artificial Sequence: Synthetic oligonucleotide"
aattacgggatgaac

SEQ ID NO: 737 - DNA, 15 bp, Artificial Sequence
  source: /note="Description of Artificial Sequence: Synthetic oligonucleotide"
aactacggcatgaac

SEQ ID NO: 738 - DNA, 51 bp, Artificial Sequence
  source: /note="Description of Artificial Sequence: Synthetic oligonucleotide"
tggattaacaccgacaccggggagcctacctacgcggacgatttcaaggga

SEQ ID NO: 739 - DNA, 51 bp, Artificial Sequence
  source: /note="Description of Artificial Sequence: Synthetic oligonucleotide"
tggatcaacaccgacaccggcgagcctacctacgccgacgacttcaagggc

SEQ ID NO: 740 - DNA, 48 bp, Artificial Sequence
  source: /note="Description of Artificial Sequence: Synthetic oligonucleotide"
aacccgccctactactacggaaccaacaacgccgaagccatggactac

SEQ ID NO: 741 - DNA, 48 bp, Artificial Sequence
  source: /note="Description of Artificial Sequence: Synthetic oligonucleotide"
aaccccccttactactacggcaccaacaacgccgaggccatggactat

SEQ ID NO: 742 - DNA, 21 bp, Artificial Sequence
  source: /note="Description of Artificial Sequence: Synthetic oligonucleotide"
ggattcaccctcaccaattac

SEQ ID NO: 743 - DNA, 21 bp, Artificial Sequence
  source: /note="Description of Artificial Sequence: Synthetic oligonucleotide"
ggcttcaccctgaccaactac

SEQ ID NO: 744 - DNA, 18 bp, Artificial Sequence
  source: /note="Description of Artificial Sequence: Synthetic oligonucleotide"
aacaccgacaccggggag

SEQ ID NO: 745 - DNA, 18 bp, Artificial Sequence
  source: /note="Description of Artificial Sequence: Synthetic oligonucleotide"
aacaccgacaccggcgag

SEQ ID NO: 746 - DNA, 33 bp, Artificial Sequence
  source: /note="Description of Artificial Sequence: Synthetic oligonucleotide"
agctctagtcaggatatctctaactacctgaac

SEQ ID NO: 747 - DNA, 33 bp, Artificial Sequence
  source: /note="Description of Artificial Sequence: Synthetic oligonucleotide"
tcctccagccaggacatctccaactacctgaac

SEQ ID NO: 748 - DNA, 21 bp, Artificial Sequence
  source: /note="Description of Artificial Sequence: Synthetic oligonucleotide"
tacactagcaccctgcacctg

SEQ ID NO: 749 - DNA, 21 bp, Artificial Sequence
  source: /note="Description of Artificial Sequence: Synthetic oligonucleotide"
tacacctccaccctgcacctg

SEQ ID NO: 750 - DNA, 27 bp, Artificial Sequence
  source: /note="Description of Artificial Sequence: Synthetic oligonucleotide"
cagcagtactataacctgccctggacc

SEQ ID NO: 751 - DNA, 27 bp, Artificial Sequence
  source: /note="Description of Artificial Sequence: Synthetic oligonucleotide"
cagcagtactacaacctgccctggacc

SEQ ID NO: 752 - DNA, 21 bp, Artificial Sequence
  source: /note="Description of Artificial Sequence: Synthetic oligonucleotide"
agtcaggatatctctaactac

SEQ ID NO: 753 - DNA, 21 bp, Artificial Sequence
  source: /note="Description of Artificial Sequence: Synthetic oligonucleotide"
agccaggacatctccaactac

SEQ ID NO: 754 - DNA, 9 bp, Artificial Sequence
  source: /note="Description of Artificial Sequence: Synthetic oligonucleotide"
tacactagc

SEQ ID NO: 755 - DNA, 9 bp, Artificial Sequence
  source: /note="Description of Artificial Sequence: Synthetic oligonucleotide"
tacacctcc

SEQ ID NO: 756 - DNA, 18 bp, Artificial Sequence
  source: /note="Description of Artificial Sequence: Synthetic oligonucleotide"
tactataacctgccctgg

SEQ ID NO: 757 - DNA, 18 bp, Artificial Sequence
  source: /note="Description of Artificial Sequence: Synthetic oligonucleotide"
tactacaacctgccctgg

SEQ ID NO: 758 - DNA, 15 bp, Artificial Sequence
  source: /note="Description of Artificial Sequence: Synthetic oligonucleotide"
aactacgggatgaac

SEQ ID NO: 759 - DNA, 51 bp, Artificial Sequence
  source: /note="Description of Artificial Sequence: Synthetic oligonucleotide"
tggattaacaccgacaccggcgagcctacctacgccgacgactttaagggc

SEQ ID NO: 760 - DNA, 48 bp, Artificial Sequence
  source: /note="Description of Artificial Sequence: Synthetic oligonucleotide"
aaccccccctactactacggcactaacaacgccgaggctatggactac

SEQ ID NO: 761 - DNA, 21 bp, Artificial Sequence
  source: /note="Description of Artificial Sequence: Synthetic oligonucleotide"
ggcttcaccctgactaactac

SEQ ID NO: 762 - protein, 447 aa, Artificial Sequence
  source: /note="Description of Artificial Sequence: Synthetic polypeptide"
QVQLQQWGAGLLKPSETLSLTCAVYGGSFSDYYWNWIRQPPGKGLEWIGEINHRGSTNSNPSLKSRVTLSLDTSKNQFSLKLRSVTAADTAVYYCAFGYSDYEYNWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 763 - protein, 214 aa, Artificial Sequence
  source: /note="Description of Artificial Sequence: Synthetic polypeptide"
EIVLTQSPATLSLSPGERATLSCRASQSISSYLAWYQQKPGQAPRLLIYDASNRATGIPARFSGSGSGTDFTLTISSLEPEDFAVYYCQQRSNWPLTFGQGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 764 - protein, 446 aa, Artificial Sequence
  source: /note="Description of Artificial Sequence: Synthetic polypeptide"
QVQLKESGPGLVAPSQSLSITCTVSGFSLTAYGVNWVRQPPGKGLEWLGMIWDDGSTDYNSALKSRLSISKDNSKSQVFLKMNSLQTDDTARYYCAREGDVAFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 765 - protein, 220 aa, Artificial Sequence
  source: /note="Description of Artificial Sequence: Synthetic polypeptide"
DIVMTQSPSSLAVSVGQKVTMSCKSSQSLLNGSNQKNYLAWYQQKPGQSPKLLVYFASTRDSGVPDRFIGSGSGTDFTLTISSVQAEDLADYFCLQHFGTPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 766 - protein, 10 aa, Artificial Sequence
  source: /note="Description of Artificial Sequence: Synthetic peptide"
GFTLTNYGMN

SEQ ID NO: 767-800 - skipped (34 entries)

SEQ ID NO: 801 - protein, 5 aa, Artificial Sequence
  source: /note="Description of Artificial Sequence: Synthetic peptide"
SYNMH

SEQ ID NO: 802 - protein, 17 aa, Artificial Sequence
  source: /note="Description of Artificial Sequence: Synthetic peptide"
DIYPGNGDTSYNQKFKG

SEQ ID NO: 803 - protein, 9 aa, Artificial Sequence
  source: /note="Description of Artificial Sequence: Synthetic peptide"
VGGAFPMDY

SEQ ID NO: 804 - protein, 7 aa, Artificial Sequence
  source: /note="Description of Artificial Sequence: Synthetic peptide"
GYTFTSY

SEQ ID NO: 805 - protein, 6 aa, Artificial Sequence
  source: /note="Description of Artificial Sequence: Synthetic peptide"
YPGNGD

SEQ ID NO: 806 - protein, 118 aa, Artificial Sequence
  source: /note="Description of Artificial Sequence: Synthetic polypeptide"
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSS

SEQ ID NO: 807 - DNA, 354 bp, Artificial Sequence
  source: /note="Description of Artificial Sequence: Synthetic polynucleotide"
caggtgcagctggtgcagtcaggcgccgaagtgaagaaacccggctctagcgtgaaagtttcttgtaaagctagtggctacaccttcactagctataatatgcactgggttcgccaggccccagggcaaggcctcgagtggatgggcgatatctaccccgggaacggcgacactagttataatcagaagtttaagggtagagtcactatcaccgccgataagtctactagcaccgtctatatggaactgagttccctgaggtctgaggacaccgccgtctactactgcgctagagtgggcggagccttccctatggactactggggtcaaggcactaccgtgaccgtgtctagc

SEQ ID NO: 808 - protein, 444 aa, Artificial Sequence
  source: /note="Description of Artificial Sequence: Synthetic polypeptide"
QVQLVQSGAEVKKPGSSVKVSCKASGYTFTSYNMHWVRQAPGQGLEWMGDIYPGNGDTSYNQKFKGRVTITADKSTSTVYMELSSLRSEDTAVYYCARVGGAFPMDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 809 - DNA, 1332 bp, Artificial Sequence
  source: /note="Description of Artificial Sequence: Synthetic polynucleotide"
caggtgcagctggtgcagtcaggcgccgaagtgaagaaacccggctctagcgtgaaagtttcttgtaaagctagtggctacaccttcactagctataatatgcactgggttcgccaggccccagggcaaggcctcgagtggatgggcgatatctaccccgggaacggcgacactagttataatcagaagtttaagggtagagtcactatcaccgccgataagtctactagcaccgtctatatggaactgagttccctgaggtctgaggacaccgccgtctactactgcgctagagtgggcggagccttccctatggactactggggtcaaggcactaccgtgaccgtgtctagcgctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 810 - protein, 15 aa, Artificial Sequence
  source: /note="Description of Artificial Sequence: Synthetic peptide"
RASESVEYYGTSLMQ

SEQ ID NO: 811 - protein, 7 aa, Artificial Sequence
  source: /note="Description of Artificial Sequence: Synthetic peptide"
AASNVES

SEQ ID NO: 812 - protein, 9 aa, Artificial Sequence
  source: /note="Description of Artificial Sequence: Synthetic peptide"
QQSRKDPST

SEQ ID NO: 813 - protein, 11 aa, Artificial Sequence
  source: /note="Description of Artificial Sequence: Synthetic peptide"
SESVEYYGTSL

SEQ ID NO: 814 - protein, 3 aa, Artificial Sequence
  source: /note="Description of Artificial Sequence: Synthetic peptide"
AAS

SEQ ID NO: 815 - protein, 6 aa, Artificial Sequence
  source: /note="Description of Artificial Sequence: Synthetic peptide"
SRKDPS

SEQ ID NO: 816 - protein, 111 aa, Artificial Sequence
  source: /note="Description of Artificial Sequence: Synthetic polypeptide"
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIK

SEQ ID NO: 817 - DNA, 333 bp, Artificial Sequence
  source: /note="Description of Artificial Sequence: Synthetic polynucleotide"
gctattcagctgactcagtcacctagtagcctgagcgctagtgtgggcgatagagtgactatcacctgtagagctagtgaatcagtcgagtactacggcactagcctgatgcagtggtatcagcagaagcccgggaaagcccctaagctgctgatctacgccgcctctaacgtggaatcaggcgtgccctctaggtttagcggtagcggtagtggcaccgacttcaccctgactatctctagcctgcagcccgaggacttcgctacctacttctgtcagcagtctaggaaggaccctagcaccttcggcggaggcactaaggtcgagattaag

SEQ ID NO: 818 - protein, 218 aa, Artificial Sequence
  source: /note="Description of Artificial Sequence: Synthetic polypeptide"
AIQLTQSPSSLSASVGDRVTITCRASESVEYYGTSLMQWYQQKPGKAPKLLIYAASNVESGVPSRFSGSGSGTDFTLTISSLQPEDFATYFCQQSRKDPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 819 - DNA, 654 bp, Artificial Sequence
  source: /note="Description of Artificial Sequence: Synthetic polynucleotide"
gctattcagctgactcagtcacctagtagcctgagcgctagtgtgggcgatagagtgactatcacctgtagagctagtgaatcagtcgagtactacggcactagcctgatgcagtggtatcagcagaagcccgggaaagcccctaagctgctgatctacgccgcctctaacgtggaatcaggcgtgccctctaggtttagcggtagcggtagtggcaccgacttcaccctgactatctctagcctgcagcccgaggacttcgctacctacttctgtcagcagtctaggaaggaccctagcaccttcggcggaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 820 - protein, 17 aa, Artificial Sequence
  source: /note="Description of Artificial Sequence: Synthetic peptide"
DIYPGQGDTSYNQKFKG

SEQ ID NO: 821 - protein, 6 aa, Artificial Sequence
  source: /note="Description of Artificial Sequence: Synthetic peptide"
YPGQGD

SEQ ID NO: 822 - protein, 118 aa, Artificial Sequence
  source: /note="Description of Artificial Sequence: Synthetic polypeptide"
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSS

SEQ ID NO: 823 - DNA, 354 bp, Artificial Sequence
  source: /note="Description of Artificial Sequence: Synthetic polynucleotide"
caggtgcagctggtgcagtcaggcgccgaagtgaagaaacccggcgctagtgtgaaagttagctgtaaagctagtggctatactttcacttcttataatatgcactgggtccgccaggccccaggtcaaggcctcgagtggatcggcgatatctaccccggtcaaggcgacacttcctataatcagaagtttaagggtagagctactatgaccgccgataagtctacttctaccgtctatatggaactgagttccctgaggtctgaggacaccgccgtctactactgcgctagagtgggcggagccttcccaatggactactggggtcaaggcaccctggtcaccgtgtctagc

SEQ ID NO: 824 - protein, 444 aa, Artificial Sequence
  source: /note="Description of Artificial Sequence: Synthetic polypeptide"
QVQLVQSGAEVKKPGASVKVSCKASGYTFTSYNMHWVRQAPGQGLEWIGDIYPGQGDTSYNQKFKGRATMTADKSTSTVYMELSSLRSEDTAVYYCARVGGAFPMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 825 - DNA, 1332 bp, Artificial Sequence
  source: /note="Description of Artificial Sequence: Synthetic polynucleotide"
caggtgcagctggtgcagtcaggcgccgaagtgaagaaacccggcgctagtgtgaaagttagctgtaaagctagtggctatactttcacttcttataatatgcactgggtccgccaggccccaggtcaaggcctcgagtggatcggcgatatctaccccggtcaaggcgacacttcctataatcagaagtttaagggtagagctactatgaccgccgataagtctacttctaccgtctatatggaactgagttccctgaggtctgaggacaccgccgtctactactgcgctagagtgggcggagccttcccaatggactactggggtcaaggcaccctggtcaccgtgtctagcgctagcactaagggcccgtccgtgttccccctggcaccttgtagccggagcactagcgaatccaccgctgccctcggctgcctggtcaaggattacttcccggagcccgtgaccgtgtcctggaacagcggagccctgacctccggagtgcacaccttccccgctgtgctgcagagctccgggctgtactcgctgtcgtcggtggtcacggtgccttcatctagcctgggtaccaagacctacacttgcaacgtggaccacaagccttccaacactaaggtggacaagcgcgtcgaatcgaagtacggcccaccgtgcccgccttgtcccgcgccggagttcctcggcggtccctcggtctttctgttcccaccgaagcccaaggacactttgatgatttcccgcacccctgaagtgacatgcgtggtcgtggacgtgtcacaggaagatccggaggtgcagttcaattggtacgtggatggcgtcgaggtgcacaacgccaaaaccaagccgagggaggagcagttcaactccacttaccgcgtcgtgtccgtgctgacggtgctgcatcaggactggctgaacgggaaggagtacaagtgcaaagtgtccaacaagggacttcctagctcaatcgaaaagaccatctcgaaagccaagggacagccccgggaaccccaagtgtataccctgccaccgagccaggaagaaatgactaagaaccaagtctcattgacttgccttgtgaagggcttctacccatcggatatcgccgtggaatgggagtccaacggccagccggaaaacaactacaagaccacccctccggtgctggactcagacggatccttcttcctctactcgcggctgaccgtggataagagcagatggcaggagggaaatgtgttcagctgttctgtgatgcatgaagccctgcacaaccactacactcagaagtccctgtccctctccctggga

SEQ ID NO: 826 - protein, 111 aa, Artificial Sequence
  source: /note="Description of Artificial Sequence: Synthetic polypeptide"
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIK

SEQ ID NO: 827 - DNA, 333 bp, Artificial Sequence
  source: /note="Description of Artificial Sequence: Synthetic polynucleotide"
gatatcgtcctgactcagtcacccgatagcctggccgtcagcctgggcgagcgggctactattaactgtagagctagtgaatcagtcgagtactacggcactagcctgatgcagtggtatcagcagaagcccggtcaaccccctaagctgctgatctacgccgcctctaacgtggaatcaggcgtgcccgataggtttagcggtagcggtagtggcaccgacttcaccctgactattagtagcctgcaggccgaggacgtggccgtctactactgtcagcagtctaggaaggaccctagcaccttcggcggaggcactaaggtcgagattaag

SEQ ID NO: 828 - protein, 218 aa, Artificial Sequence
  source: /note="Description of Artificial Sequence: Synthetic polypeptide"
DIVLTQSPDSLAVSLGERATINCRASESVEYYGTSLMQWYQQKPGQPPKLLIYAASNVESGVPDRFSGSGSGTDFTLTISSLQAEDVAVYYCQQSRKDPSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 829 - DNA, 654 bp, Artificial Sequence
  source: /note="Description of Artificial Sequence: Synthetic polynucleotide"
gatatcgtcctgactcagtcacccgatagcctggccgtcagcctgggcgagcgggctactattaactgtagagctagtgaatcagtcgagtactacggcactagcctgatgcagtggtatcagcagaagcccggtcaaccccctaagctgctgatctacgccgcctctaacgtggaatcaggcgtgcccgataggtttagcggtagcggtagtggcaccgacttcaccctgactattagtagcctgcaggccgaggacgtggccgtctactactgtcagcagtctaggaaggaccctagcaccttcggcggaggcactaaggtcgagattaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 830 - protein, 114 aa, Artificial Sequence
  source: /note="Description of Artificial Sequence: Synthetic polypeptide"
EVQLLESGGGLVQPGGSLRLSCAAASGFTFSSYDMSWVRQAPGKGLDWVSTISGGGTYTYYQDSVKGRFTISRDNSKNTLYLQMNSLRAEDTAVYYCASMDYWGQGTTVTVSSA

SEQ ID NO: 831 - protein, 108 aa, Artificial Sequence
  source: /note="Description of Artificial Sequence: Synthetic polypeptide"
DIQMTQSPSSLSASVGDRVTITCRASQSIRRYLNWYHQKPGKAPKLLIYGASTLQSGVPSRFSGSGSGTDFTLTISSLQPEDFAVYYCQQSHSAPLTFGGGTKVEIKR

SEQ ID NO: 832 - protein, 120 aa, Artificial Sequence
  source: /note="Description of Artificial Sequence: Synthetic polypeptide"
EVQVLESGGGLVQPGGSLRLYCVASGFTFSGSYAMSWVRQAPGKGLEWVSAISGSGGSTYYADSVKGRFTISRDNSKNTLYLQMNSLRAEDTAVYYCAKKYYVGPADYWGQGTLVTVSSG

SEQ ID NO: 833 - protein, 113 aa, Artificial Sequence
  source: /note="Description of Artificial Sequence: Synthetic polypeptide"
DIVMTQSPDSLAVSLGERATINCKSSQSVLYSSNNKNYLAWYQHKPGQPPKLLIYWASTRESGVPDRFSGSGSGTDFTLTISSLQAEDVAVYYCQQYYSSPLTFGGGTKIEVK

SEQ ID NO: 834-900 - skipped (67 entries)

SEQ ID NO: 901 - protein, 121 aa, Artificial Sequence
  source: /note="Description of Artificial Sequence: Synthetic polypeptide"
EVQLVESGGGLVQSGGSLRLSCAASGFSLSSYGVDWVRQAPGKGLEWVGVIWGGGGTYYASSLMGRFTISRDNSKNTLYLQMNSLRAEDTAVYYCARHAYGHDGGFAMDYWGQGTLVTVSS

SEQ ID NO: 902 - protein, 107 aa, Artificial Sequence
  source: /note="Description of Artificial Sequence: Synthetic polypeptide"
EIVMTQSPATLSVSPGERATLSCRASESVSSNVAWYQQRPGQAPRLLIYGASNRATGIPARFSGSGSGTDFTLTISRLEPEDFAVYYCGQSYSYPFTFGQGTKLEIK

SEQ ID NO: 903 - protein, 451 aa, Artificial Sequence
  source: /note="Description of Artificial Sequence: Synthetic polypeptide"
EVQLVESGGGLVQSGGSLRLSCAASGFSLSSYGVDWVRQAPGKGLEWVGVIWGGGGTYYASSLMGRFTISRDNSKNTLYLQMNSLRAEDTAVYYCARHAYGHDGGFAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 904 - protein, 214 aa, Artificial Sequence
  source: /note="Description of Artificial Sequence: Synthetic polypeptide"
EIVMTQSPATLSVSPGERATLSCRASESVSSNVAWYQQRPGQAPRLLIYGASNRATGIPARFSGSGSGTDFTLTISRLEPEDFAVYYCGQSYSYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 905 - DNA, 363 bp, Artificial Sequence
  source: /note="Description of Artificial Sequence: Synthetic polynucleotide"
gaggtgcagctggtggaatctggcggcggactggtgcagtccggcggctctctgagactgtcttgcgctgcctccggcttctccctgtcctcttacggcgtggactgggtgcgacaggcccctggcaagggcctggaatgggtgggagtgatctggggcggaggcggcacctactacgcctcttccctgatgggccggttcaccatctcccgggacaactccaagaacaccctgtacctgcagatgaactccctgcgggccgaggacaccgccgtgtactactgcgccagacacgcctacggccacgacggcggcttcgccatggattattggggccagggcaccctggtgacagtgtcctcc

SEQ ID NO: 906 - DNA, 321 bp, Artificial Sequence
  source: /note="Description of Artificial Sequence: Synthetic polynucleotide"
gagatcgtgatgacccagtcccccgccaccctgtctgtgtctcccggcgagagagccaccctgagctgcagagcctccgagtccgtgtcctccaacgtggcctggtatcagcagagacctggtcaggcccctcggctgctgatctacggcgcctctaaccgggccaccggcatccctgccagattctccggctccggcagcggcaccgacttcaccctgaccatctcccggctggaacccgaggacttcgccgtgtactactgcggccagtcctactcataccccttcaccttcggccagggcaccaagctggaaatcaag

SEQ ID NO: 907 - DNA, 1353 bp, Artificial Sequence
  source: /note="Description of Artificial Sequence: Synthetic polynucleotide"
gaggtgcagctggtggaatctggcggcggactggtgcagtccggcggctctctgagactgtcttgcgctgcctccggcttctccctgtcctcttacggcgtggactgggtgcgacaggcccctggcaagggcctggaatgggtgggagtgatctggggcggaggcggcacctactacgcctcttccctgatgggccggttcaccatctcccgggacaactccaagaacaccctgtacctgcagatgaactccctgcgggccgaggacaccgccgtgtactactgcgccagacacgcctacggccacgacggcggcttcgccatggattattggggccagggcaccctggtgacagtgtcctccgctagcaccaagggcccaagtgtgtttcccctggcccccagcagcaagtctacttccggcggaactgctgccctgggttgcctggtgaaggactacttccccgagcccgtgacagtgtcctggaactctggggctctgacttccggcgtgcacaccttccccgccgtgctgcagagcagcggcctgtacagcctgagcagcgtggtgacagtgccctccagctctctgggaacccagacctatatctgcaacgtgaaccacaagcccagcaacaccaaggtggacaagagagtggagcccaagagctgcgacaagacccacacctgccccccctgcccagctccagaactgctgggagggccttccgtgttcctgttcccccccaagcccaaggacaccctgatgatcagcaggacccccgaggtgacctgcgtggtggtggacgtgtcccacgaggacccagaggtgaagttcaactggtacgtggacggcgtggaggtgcacaacgccaagaccaagcccagagaggagcagtacaacagcacctacagggtggtgtccgtgctgaccgtgctgcaccaggactggctgaacggcaaagaatacaagtgcaaagtctccaacaaggccctgccagccccaatcgaaaagacaatcagcaaggccaagggccagccacgggagccccaggtgtacaccctgccccccagccgggaggagatgaccaagaaccaggtgtccctgacctgtctggtgaagggcttctaccccagcgatatcgccgtggagtgggagagcaacggccagcccgagaacaactacaagaccacccccccagtgctggacagcgacggcagcttcttcctgtacagcaagctgaccgtggacaagtccaggtggcagcagggcaacgtgttcagctgcagcgtgatgcacgaggccctgcacaaccactacacccagaagtccctgagcctgagccccggcaag

SEQ ID NO: 908 - DNA, 642 bp, Artificial Sequence
  source: /note="Description of Artificial Sequence: Synthetic polynucleotide"
gagatcgtgatgacccagtcccccgccaccctgtctgtgtctcccggcgagagagccaccctgagctgcagagcctccgagtccgtgtcctccaacgtggcctggtatcagcagagacctggtcaggcccctcggctgctgatctacggcgcctctaaccgggccaccggcatccctgccagattctccggctccggcagcggcaccgacttcaccctgaccatctcccggctggaacccgaggacttcgccgtgtactactgcggccagtcctactcataccccttcaccttcggccagggcaccaagctggaaatcaagcgtacggtggccgctcccagcgtgttcatcttcccccccagcgacgagcagctgaagagcggcaccgccagcgtggtgtgcctgctgaacaacttctacccccgggaggccaaggtgcagtggaaggtggacaacgccctgcagagcggcaacagccaggagagcgtcaccgagcaggacagcaaggactccacctacagcctgagcagcaccctgaccctgagcaaggccgactacgagaagcataaggtgtacgcctgcgaggtgacccaccagggcctgtccagccccgtgaccaagagcttcaacaggggcgagtgc

SEQ ID NO: 909 - protein, 5 aa, Artificial Sequence
  source: /note="Description of Artificial Sequence: Synthetic peptide"
SYGVD

SEQ ID NO: 910 - protein, 7 aa, Artificial Sequence
  source: /note="Description of Artificial Sequence: Synthetic peptide"
GFSLSSY

SEQ ID NO: 911 - protein, 16 aa, Artificial Sequence
  source: /note="Description of Artificial Sequence: Synthetic peptide"
VIWGGGGTYYASSLMG

SEQ ID NO: 912 - protein, 5 aa, Artificial Sequence
  source: /note="Description of Artificial Sequence: Synthetic peptide"
WGGGG

SEQ ID NO: 913 - protein, 13 aa, Artificial Sequence
  source: /note="Description of Artificial Sequence: Synthetic peptide"
HAYGHDGGFAMDY

SEQ ID NO: 914 - protein, 11 aa, Artificial Sequence
  source: /note="Description of Artificial Sequence: Synthetic peptide"
RASESVSSNVA

SEQ ID NO: 915 - protein, 7 aa, Artificial Sequence
  source: /note="Description of Artificial Sequence: Synthetic peptide"
SESVSSN

SEQ ID NO: 916 - protein, 7 aa, Artificial Sequence
  source: /note="Description of Artificial Sequence: Synthetic peptide"
GASNRAT

SEQ ID NO: 917 - protein, 3 aa, Artificial Sequence
  source: /note="Description of Artificial Sequence: Synthetic peptide"
GAS

SEQ ID NO: 918 - protein, 9 aa, Artificial Sequence
  source: /note="Description of Artificial Sequence: Synthetic peptide"
GQSYSYPFT

SEQ ID NO: 919 - protein, 6 aa, Artificial Sequence
  source: /note="Description of Artificial Sequence: Synthetic peptide"
SYSYPF

SEQ ID NO: 920 - protein, 124 aa, Artificial Sequence
  source: /note="Description of Artificial Sequence: Synthetic polypeptide"
QVQLVESGGGVVQPGRSLRLSCAASGFTFSSYGMHWVRQAPGKGLEWVAVIWYEGSNKYYADSVKGRFTISRDNSKNTLYLQMNSLRAEDTAVYYCARGGSMVRGDYYYGMDVWGQGTTVTVSS

SEQ ID NO: 921 - protein, 107 aa, Artificial Sequence
  source: /note="Description of Artificial Sequence: Synthetic polypeptide"
AIQLTQSPSSLSASVGDRVTITCRASQGISSALAWYQQKPGKAPKLLIYDASSLESGVPSRFSGSGSGTDFTLTISSLQPEDFATYYCQQFNSYPYTFGQGTKLEIK

SEQ ID NO: 922-1000 - skipped (79 entries)

SEQ ID NO: 1001 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1002 - protein, 170 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQG

SEQ ID NO: 1003 - protein, 114 aa, Artificial Sequence
  source: /note="Description of Artificial Sequence: Synthetic polypeptide"
NWVNVISDLKKIEDLIQSMHIDATLYTESDVHPSCKVTAMKCFLLELQVISLESGDASIHDTVENLIILANDSLSSNGNVTESGCKECEELEEKNIKEFLQSFVHIVQMFINTS

SEQ ID NO: 1004 - protein, 297 aa, Artificial Sequence
  source: /note="Description of Artificial Sequence: Synthetic polypeptide"
ITCPPPMSVEHADIWVKSYSLYSRERYICNSGFKRKAGTSSLTECVLNKATNVAHWTTPSLKCIREPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1005 - protein, 114 aa, Artificial Sequence; identical to SEQ ID NO: 1001
  source: /note="Description of Artificial Sequence: Synthetic polypeptide"
  VARIANT (93)..(93): /replace="Lys"
  SITE (1)..(114): /note="Variant residues given in the sequence have no preference with respect to those in the annotations for variant positions"

SEQ ID NO: 1006 - protein, 77 aa, Artificial Sequence
  source: /note="Description of Artificial Sequence: Synthetic polypeptide"
ITCPPPMSVEHADIWVKSYSLYSRERYICNSGFKRKAGTSSLTECVLNKATNVAHWTTPSLKCIRDPALVHQRPAPP

SEQ ID NO: 1007 - protein, 422 aa, Artificial Sequence
  source: /note="Description of Artificial Sequence: Synthetic polypeptide"
MDWTWILFLVAAATRVHSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSSGGGSGGGGSGGGGSGGGGSGGGSLQITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHLSRMDYKDDDDKDYKDDDDKDYKDDDDK

SEQ ID NO: 1008 - protein, 209 aa, Artificial Sequence
  source: /note="Description of Artificial Sequence: Synthetic polypeptide"
CPPPMSVEHADIWVKSYSLYSRERYICNSGFKRKAGTSSLTECVLNKATNVAHWTTPSLKCIRDPALVHQRPAPPSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1009 - protein, 459 aa, Artificial Sequence
  source: /note="Description of Artificial Sequence: Synthetic polypeptide"
ACDCRGDCFCGGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSPPPMSVEHADIWVKSYSLYSRERYICNSGFKRKAGTSSLTECVLNKATNVAHWTTPSLKCIRDPALVHQRPAPPSTVSGGSGGGGSGGGSGGGGSLQNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 1010 - protein, 6 aa, Artificial Sequence
  source: /note="Description of Artificial Sequence: Synthetic 6xHis tag"
HHHHHH

SEQ ID NO: 1011 - protein, 4 aa, Artificial Sequence
  source: /note="Description of Artificial Sequence: Synthetic peptide"
RGDS

SEQ ID NO: 1012 - protein, 447 aa, Artificial Sequence
  source: /note="Description of Artificial Sequence: Synthetic polypeptide"
QVQLVQSGAEVKKPGSSVKVSCKASGYTFSSNVISWVRQAPGQGLEWMGGVIPIVDIANYAQRFKGRVTITADESTSTTYMELSSLRSEDTAVYYCASTLGLVLDAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1013 - protein, 215 aa, Artificial Sequence
  source: /note="Description of Artificial Sequence: Synthetic polypeptide"
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1014 - protein, 478 aa, Artificial Sequence
  source: /note="Description of Artificial Sequence: Synthetic polypeptide"
MLLVNQSHQGFNKEHTSKMVSAIVLYVLLAAAAHSAFATRDVREPPALKYGIVLDAGSSHTSMFIYKWPADKENDTGIVGQHSSCDVPGGGISSYADNPSGASQSLVGCLEQALQDVPKERHAGTPLYLGATAGMRLLNLTNPEASTSVLMAVTHTLTQYPFDFRGARILSGQEEGVFGWVTANYLLENFIKYGWVGRWFRPRKGTLGAMDLGGASTQITFETTSPAEDRASEVQLHLYGQHYRVYTHSFLCYGRDQVLQRLLASALQTHGFHPCWPRGFSTQVLLGDVYQSPCTMAQRPQNFNSSARVSLSGSSDPHLCRDLVSGLFSFSSCPFSRCSFNGVFQPPVAGNFVAFSAFFATVDFLRTSMGLPVATLQQLEAAAVNVCNQTWAQLQARVPGQRARLADYCAGAMFVQQLLSRGYGFDERAFGGVIFQKKAADTAVGWALGYMLNLTNLIPADPPGLRKGTDFSHHHHHH

SEQ ID NO: 1015 - protein, 478 aa, Artificial Sequence
  source: /note="Description of Artificial Sequence: Synthetic polypeptide"
MLLVNQSHQGFNKEHTSKMVSAIVLYVLLAAAAHSAFATQDVREPPALKYGIVLDAGSSHTSMFVYKWPADKENDTGIVGQHSSCDVRGGGISSYANDPSRAGQSLVECLEQALRDVPKDRYASTPLYLGATAGMRLLNLTSPEATAKVLEAVTQTLTRYPFDFRGARILSGQDEGVFGWVTANYLLENFIKYGWVGRWIRPRKGTLGAMDLGGASTQITFETTSPSEDPDNEVHLRLYGQHYRVYTHSFLCYGRDQVLQRLLASALQIHRFHPCWPKGYSTQVLLREVYQSPCTMGQRPQTFNSSATVSLSGTSNAALCRDLVSGLFNISSCPFSQCSFNGVFQPPVAGNFIAFSAFYYTVDFLKTVMGLPVGTLKQLEDATETTCNQTWAELQARVPGQQTRLPDYCAVAMFIHQLLSRGYRFDERSFRGVVFEKKAADTAVGWALGYMLNLTNLIPADLPGLRKGTHFSHHHHHH

The invention claimed is:

1. An antibody or antigen binding fragment thereof that specifically binds to human ENTPD2 protein, wherein the antibody or antigen binding fragment thereof comprises a heavy chain complementary determining region 1 (HCDR1), a heavy chain complementary determining region 2 (HCDR2), a heavy chain complementary determining region 3 (HCDR3), a light chain complementary determining region 1 (LCDR1), a light chain complementary determining region 2 (LCDR2), and a light chain complementary determining region 3 (LCDR3), wherein the antibody or antigen binding fragment thereof is selected from any one of the following:
   1) an antibody or antigen binding fragment thereof comprising:
      an HCDR1 sequence comprising SEQ ID NO: 1,
      an HCDR2 sequence comprising SEQ ID NO: 2,
      an HCDR3 sequence comprising SEQ ID NO: 3,
      an LCDR1 sequence comprising SEQ ID NO: 14,
      an LCDR2 sequence comprising SEQ ID NO: 15, and
      an LCDR3 sequence comprising SEQ ID NO: 16;
   2) an antibody or antigen binding fragment thereof comprising:
      an HCDR1 sequence comprising SEQ ID NO: 4,
      an HCDR2 sequence comprising SEQ ID NO: 5,
      an HCDR3 sequence comprising SEQ ID NO: 3,
      an LCDR1 sequence comprising SEQ ID NO: 17,
      an LCDR2 sequence comprising SEQ ID NO: 18, and
      an LCDR3 sequence comprising SEQ ID NO: 19; or,
   3) an antibody or antigen binding fragment thereof comprising:
      an HCDR1 sequence comprising SEQ ID NO: 7,
      an HCDR2 sequence comprising SEQ ID NO: 8,
      an HCDR3 sequence comprising SEQ ID NO: 9,
      an LCDR1 sequence comprising SEQ ID NO: 20,
      an LCDR2 sequence comprising SEQ ID NO: 18, and
      an LCDR3 sequence comprising SEQ ID NO: 16.

2. The antibody or antigen binding fragment thereof of claim 1, wherein the antibody or antigen binding fragment thereof is selected from any one of the following:
   1) an antibody or antigen binding fragment thereof comprising a heavy chain variable region (VH) comprising SEQ ID NO: 10 or a sequence at least about 95% or more identical thereto, and a light chain variable region (VL) comprising SEQ ID NO: 21 or a sequence at least about 95% or more identical thereto;
   2) an antibody or antigen binding fragment thereof comprising a VH comprising SEQ ID NO: 25 or a sequence at least about 95% or more identical thereto, and a VL comprising SEQ ID NO: 29 or a sequence at least about 95% or more identical thereto;
   3) an antibody or antigen binding fragment thereof comprising a VH comprising SEQ ID NO: 33 or a sequence at least about 95% or more identical thereto, and a VL comprising SEQ ID NO: 29 or a sequence at least about 95% or more identical thereto;

4) an antibody or antigen binding fragment thereof comprising a VH comprising SEQ ID NO: 25 or a sequence at least about 95% or more identical thereto, and a VL comprising SEQ ID NO: 78 or a sequence at least about 95% or more identical thereto; or, 5) an antibody or antigen binding fragment thereof comprising a VH comprising SEQ ID NO: 233 or a sequence at least about 95% or more identical thereto, and a VL comprising SEQ ID NO: 237 or a sequence at least about 95% or more identical thereto.

3. The antibody or antigen binding fragment thereof of claim 1, wherein the antibody or antigen binding fragment thereof is selected from any one of the following:
1) an antibody comprising a heavy chain comprising SEQ ID NO: 12 or a sequence at least about 95% or more identical thereto, and a light chain comprising SEQ ID NO: 23 or a sequence at least about 95% or more identical thereto;
2) an antibody comprising a heavy chain comprising SEQ ID NO: 27 or a sequence at least about 95% or more identical thereto, and a light chain comprising SEQ ID NO: 31 or a sequence at least about 95% or more identical thereto;
3) an antibody comprising a heavy chain comprising SEQ ID NO: 35 or a sequence at least about 95% or more identical thereto, and a light chain comprising SEQ ID NO: 31 or a sequence at least about 95% or more identical thereto;
4) an antibody comprising a heavy chain comprising SEQ ID NO: 27 or a sequence at least about 95% or more identical thereto, and a light chain comprising SEQ ID NO: 80 or a sequence at least about 95% or more identical thereto; Q.L,
5) an antibody comprising a heavy chain comprising SEQ ID NO: 235 or a sequence at least about 95% or more identical thereto, and a light chain comprising SEQ ID NO: 239 or a sequence at least about 95% or more identical thereto.

4. The antibody or antigen binding fragment thereof of claim 1, wherein the antibody or antigen-binding fragment thereof binds to human ENTPD2 protein with a dissociation constant ($K_D$) of less than 10 nM as measured by surface plasmon resonance (SPR).

5. The antibody or antigen binding fragment thereof of claim 1, wherein the antibody or antigen binding fragment thereof inhibits human ENTPD2 enzymatic activity by at least 40%.

6. The antibody or antigen binding fragment thereof of claim 1, wherein the antibody or antigen binding fragment thereof comprises a modified Fc region that has reduced antibody-dependent cellular cytotoxicity (ADCC) or complement-dependent cytotoxicity (CDC) activity compared to the parent antibody.

7. A pharmaceutical composition comprising the antibody or antigen binding fragment thereof of claim 1 and a pharmaceutically acceptable carrier.

8. A method of treating an ENTPD2+ cancer in a subject in need thereof, the method comprising administering to the subject a therapeutically effective amount of the pharmaceutical composition of claim 7.

9. The method of claim 8, wherein the ENTPD2+ cancer is colorectal cancer (CRC), gastric cancer, esophageal cancer, lung cancer, breast cancer, or ovarian cancer.

10. The method of claim 8, wherein the pharmaceutical composition is administered to the subject through an intravenous, intratumoral or subcutaneous route.

11. A method of stimulating an immune response in a subject, the method comprising administering to the subject the pharmaceutical composition of claim 7, in an amount effective to stimulate the immune response.

12. The method of claim 8 further comprising administering to the subject at least one additional therapeutic agent or procedure.

13. The method of claim 12, wherein the at least one additional therapeutic agent is a PD-1 inhibitor, wherein the PD-1 inhibitor is selected from PDR001, Nivolumab, Pembrolizumab, Pidilizumab, MEDI0680, REGN2810, TSR-042, PF-06801591, BGB-A317, or AMP-224.

14. The method of claim 12, wherein the at least one additional therapeutic agent is a PD-L1 inhibitor wherein the PD-L1 inhibitor is selected from FAZ053, Atezolizumab, Avelumab, Durvalumab, or BMS-936559.

15. The method of claim 12, wherein the at least one additional therapeutic agent is an A2AR antagonist, wherein the A2AR antagonist is selected from:
i. an anti-CD73 antibody molecule, or antigen-binding fragment thereof, optionally wherein the anti-CD73 antibody is selected from:
a. an anti-CD73 antibody molecule comprising a heavy chain variable region comprising the amino acid sequence of SEQ ID NO: 295 and a light chain variable region comprising the amino acid sequence of SEQ ID NO: 296, or an amino acid sequence at least 85%, 90%, 95% identical or higher to SEQ ID NO: 295 or 296;
b. an anti-CD73 antibody molecule comprising a heavy chain variable region comprising the amino acid sequence of SEQ ID NO: 299 and a light chain variable region comprising the amino acid sequence of SEQ ID NO: 300, or an amino acid sequence at least 85%, 90%, 95% identical or higher to SEQ ID NO: 299 or 300;
c. an anti-CD73 antibody molecule comprising a heavy chain variable region comprising the amino acid sequence of SEQ ID NO: 302 and a light chain variable region comprising the amino acid sequence of SEQ ID NO: 303, or an amino acid sequence at least 85%, 90%, 95% identical or higher to SEQ ID NO: 302 or 303;
d. an anti-CD73 antibody molecule comprising a heavy chain variable region comprising the amino acid sequence of SEQ ID NO: 304 and a light chain variable region comprising the amino acid sequence of SEQ ID NO: 305, or an amino acid sequence at least 85%, 90%, 95% identical or higher to SEQ ID NO: 304 or 305;
e. an anti-CD73 antibody molecule comprising a heavy chain variable region comprising the amino acid sequence of SEQ ID NO: 306 and a light chain variable region comprising the amino acid sequence of SEQ ID NO: 307, or an amino acid sequence at least 85%, 90%, 95% identical or higher to SEQ ID NO: 306 or 307; or
f. an anti-CD73 antibody molecule comprising a heavy chain variable region comprising the amino acid sequence of SEQ ID NO: 308 and a light chain variable region comprising the amino acid sequence of SEQ ID NO: 309, or an amino acid sequence at least 85%, 90%, 95% identical or higher to SEQ ID NO: 308 or 309; or
ii. PBF509/NIR178, CPI444/V81444, AZD4635/HTL-1071, Vipadenant, GBV-2034, AB928, Theophylline, Istradefylline, Tozadenant/SYN-115, KW-6356, ST-4206, and Preladenant/SCH 420814; or
iii. 5-bromo-2,6-di-(1H-pyrazol-1-yl)pyrimidine-4-amine, or a pharmaceutically acceptable salt thereof; (S)-7-(5-methylfuran-2-yl)-34(6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof; (R)-7-(5-methylfuran-2-yl)-3-((6-(((tetrahydrofuran-3-yl)oxy)methyl)pyridin-2-yl) methyl)-3H-[1,2,3]triazolo[4,5-d]pyrimidin-5-amine, or a pharmaceutically acceptable salt thereof, or racemate thereof, or a pharmaceutically acceptable salt thereof; 7-(5-methylfuran-2-yl)-3-((6-(((tetrahydrofuran-3-yl)oxy)methyl)pyridin-2-yl)methyl)-3H-[1,2,3]triazolo[4,5-d]pyrimidin-5-amine, or a pharmaceutically acceptable salt thereof; and 6-(2-chloro-6-methylpyridin-4-yl)-5-(4-fluorophenyl)-1,2,4-triazin-3-amine, or a pharmaceutically acceptable salt thereof.

16. The method of claim 12, wherein the at least one additional therapeutic agent is selected from:
  i. a CTLA-4 inhibitor, optionally wherein the CTLA-4 inhibitor is selected from Ipilimumab or Tremelimumab;
  ii. a TIM-3 inhibitor, optionally wherein the TIM-3 inhibitor is selected from MBG453, TSR-022, or LY3321367;
  iii. a LAG-3 inhibitor, optionally wherein the LAG-3 inhibitor is selected from LAG525, BMS-986016, TSR-033, MK-4280 or REGN3767;
  iv. a GITR agonist, optionally wherein the GITR agonist is selected from GWN323, BMS-986156, MK-4166, MK-1248, TRX518, INCAGN1876, AMG 228, or INBRX-110;
  v. an anti-CD3 multispecific antibody molecule, optionally wherein the anti-CD3 multispecific antibody molecule is an anti-CD3×anti-CD123 bispecific antibody molecule (e.g., XENP14045), or an anti-CD3×anti-CD20 bispecific antibody molecule (e.g., XENP13676);
  vi. a cytokine molecule, optionally wherein the cytokine molecule is IL-15 complexed with a soluble form of IL-15 receptor alpha (IL-15Ra);
  vii. a macrophage colony-stimulating factor (M-CSF) inhibitor, optionally wherein the M-CSF inhibitor is MCS110;
  viii. a CSF-1R inhibitor, optionally wherein the CSF-1R inhibitor is BLZ945;
  ix. an inhibitor of indoleamine 2,3-dioxygenase (IDO) and/or tryptophan 2,3-dioxygenase (TDO);
  x. a TGF-β inhibitor;
  xi. an oncolytic virus; or,
  xii. a chimeric antigen receptor (CAR) T-cell therapy.

17. The method of claim 12, wherein the at least one additional therapeutic agent is selected from: 1) a protein kinase C (PKC) inhibitor; 2) a heat shock protein 90 (HSP90) inhibitor; 3) an inhibitor of a phosphoinositide 3-kinase (PI3K) and/or target of rapamycin (mTOR); 4) an inhibitor of cytochrome P450; 5) an iron chelating agent; 6) an aromatase inhibitor; 7) an inhibitor of p53 8) an apoptosis inducer; 9) an angiogenesis inhibitor; 10) an aldosterone synthase inhibitor; 11) a smoothened (SMO) receptor inhibitor; 12) a prolactin receptor (PRLR) inhibitor; 13) a Wnt signaling inhibitor; 14) a CDK4/6 inhibitor; 15) a fibroblast growth factor receptor 2 (FGFR2)/fibroblast growth factor receptor 4 (FGFR4) inhibitor; 16) an inhibitor of macrophage colony-stimulating factor (M-CSF); 17) an inhibitor of one or more of c-KIT, histamine release, Flt3 or PKC; 18) an inhibitor of one or more of VEGFR-2, PDGFRbeta, c-KIT or Raf kinase C; 19) a somatostatin agonist and/or a growth hormone release inhibitor; 20) an anaplastic lymphoma kinase (ALK) inhibitor; 21) an insulin-like growth factor 1 receptor (IGF-1R) inhibitor; 22) a P-Glycoprotein 1 inhibitor; 23) a vascular endothelial growth factor receptor (VEGFR) inhibitor; 24) a BCR-ABL kinase inhibitor; 25) an FGFR inhibitor; 26) an inhibitor of CYP11B2; 27) a HDM2 inhibitor; 28) an inhibitor of a tyrosine kinase; 29) an inhibitor of c-MET; 30) an inhibitor of JAK; 31) an inhibitor of DAC; 32) an inhibitor of 11β-hydroxylase; 33) an inhibitor of IAP; 34) an inhibitor of PIM kinase; 35) an inhibitor of Porcupine; 36) an inhibitor of BRAF; 37) an inhibitor of HER3; 38) an inhibitor of MEK; or 39) an inhibitor of a lipid kinase.

18. The method of claim 8, wherein administering the pharmaceutical composition has one or more of the following effects:
  (a) increased number of CD45+ CD4− CD8+ CD69+ CD25+ cells in a tumor or lesion site in the subject;
  (b) increased number of CD45+ CD8− CD4+ FOXP3− CD69+ CD25+ cells in a tumor or lesion site in the subject;
  (c) decreased plasma MCP1 or IL-1β level in the subject; or
  (d) increased MCP1 level in a tumor or lesion site in the subject.

* * * * *